United States Patent 11,446,398 (REGULATED BIOCIRCUIT SYSTEMS) - sequence listing, part 61

SEQ ID NO: 156943 - DNA, 7774 bp, Homo sapiens
  Payload ID: 10755
  Gene Symbol: MYO18B
  Gene Name: myosin XVIIIB
  ENST ID: ENST00000539302
  CDS Start-End: 60-2456
ctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttggattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaaggaatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcgg

SEQ ID NO: 156944 - DNA, 8051 bp, Homo sapiens
  Payload ID: 10755
  Gene Symbol: MYO18B
  Gene Name: myosin XVIIIB
  ENST ID: ENST00000536101
  CDS Start-End: 260-7963
ggcagtaaggggaagggatgtgtgtcggtgtgtgtggagagggtgctccttcgctcctgctttcccggctcggtggggtcccttcgcggccacccggggagacgtcttagacagtcgtggttcctgtgatctgtgtcctctttgcagaagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttggattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaaggaatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcaggtaaaagcaacaggctggggctattcttgggggaatgagagttcaccttgcagccttggggagagcaggtgccact

SEQ ID NO: 156945 - DNA, 1099 bp, Homo sapiens
  Payload ID: 10755
  Gene Symbol: MYO18B
  Gene Name: myosin XVIIIB
  Uniprot ID: Q8IUG5
  ENST ID: ENST00000540454
  CDS Start-End: 1-630
ccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcaggagctgtgatggcgttctgtccacataatgacagaagatccgtggtgggatcacagacatgcaaagggccaagttggaagagaccttcagaatagtggagtccacttgcattgcatatggagagaaactgaggccctaggttcaggggggagggaacaagtacaaaaatcacagagcaacaatgcaggataagtaactacttgctgcccttcctccctctcctagcactcatcctgccactcatctggagtcaagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggca

SEQ ID NO: 156946 - DNA, 1768 bp, Homo sapiens
  Payload ID: 10755
  Gene Symbol: MYO18B
  Gene Name: myosin XVIIIB
  ENST ID: ENST00000543971
  CDS Start-End: 1-1553
aagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcat

SEQ ID NO: 156947 - DNA, 6024 bp, Homo sapiens
  Payload ID: 10756
  Gene Symbol: MYH1
  Gene Name: myosin, heavy chain 1, skeletal muscle, adult
  Uniprot ID: P12882
  ENST ID: ENST00000226207
  CDS Start-End: 96-5915
tgtctctcctcataaagcttcaagttctgatccactttaaggtcgcatctctacgccagggtccttaactgggctaccatcaataacctgcagccatgagttccgactctgagatggccatttttggggaggctgctcctttcctccgaaagtctgaaagggagcgaattgaagcccagaacaagccttttgatgccaagacatcagtctttgtggtggaccctaaggagtcctttgtgaaagcaacagtgcagagcagggaaggggggaaggtgacagctaagaccgaagctggagctactgtaacagtgaaagatgaccaagtcttccccatgaaccctcccaaatatgacaagatcgaggacatggccatgatgactcatctacacgagcctgctgtgctgtacaacctcaaagagcgctacgcagcctggatgatctacacctactcaggcttgttctgtgtcactgtcaacccctacaagtggttgccagtgtataatgcagaggtggtgacagcctaccgaggcaaaaagcgccaggaggccccaccccacatcttctccatctctgacaatgcctatcagttcatgctgactgatcgggagaatcagtctatcttgatcaccggagaatctggcgcagggaagactgtgaacaccaagcgtgtcatccagtactttgcaacaattgcagttactggggagaagaagaaggaagaagttacttctggcaaaatgcaggggactctggaagatcaaatcatcagtgccaaccccctactggaggcctttggcaacgccaagaccgtgaggaatgacaactcctctcgctttggtaaattcatcaggatccacttcggtaccacagggaaactggcttctgctgatattgaaacatatcttctggagaagtctagagttactttccagctaaaggctgaaagaagctatcatattttttatcagatcatgtctaacaagaagccagatctaattgaaatgctcctgatcaccaccaacccatacgattatgccttcgtcagtcaaggggagatcacagtgcccagcattgatgaccaagaagagttgatggctacagatagtgccattgaaattctgggctttacttcagatgaaagagtgtccatctataagctcacaggggctgtgatgcattatgggaacatgaaattcaagcaaaagcagcgtgaggagcaagctgagccagatggcactgaagttgctgacaaggcagcctatctccaaaatctgaactctgcagatctgctcaaagccctctgctaccctagggtcaaggtcggcaatgagtatgtcaccaaaggtcaaactgtgcagcaggtgtacaatgcagtgggtgctctggccaaagctgtctacgataagatgttcttgtggatggtcacccgcatcaaccagcagctggacaccaagcagcccaggcagtacttcattggggtcttggacattgctggctttgagatctttgatttcaacagcctggagcagctgtgcatcaacttcaccaatgagaaactgcaacagtttttcaaccaccacatgttcgtgctggagcaggaggagtacaagaaggaaggcattgagtggacgttcattgactttgggatggacctggctgcctgcatcgagctcatcgagaagcctatgggcatcttctccatcctggaagaggagtgcatgttccccaaggcgacagacacctccttcaagaacaagctgtatgaacaacatcttggaaaatccaataacttccagaagcccaagcctgccaaaggcaagcctgaggcccacttctctttgattcactatgctggcaccgtggactacaacattgccggctggcttgacaagaacaaggaccccctgaatgagactgtggtggggctgtaccagaagtctgcaatgaagactctggctctcctctttgttggggcaacgggagcggaagcagaggctggcggtggaaagaaaggtggtaagaagaagggttcttctttccagactgtgtctgctctcttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggtgttaaatgcaagtgctatccctgaaggacaattcatcgatagcaagaaggcttcagagaagctcctggggtccattgacattgaccacacccagtataaatttggtcacaccaaggtctttttcaaagctggtcttctggggctcctagaggagatgcgagatgagaagctggcccagctgattacccgaacccaggccatgtgcagagggttcttggcaagagtggagtaccagaaaatggtggaaagaagagagtccatcttctgcatccagtacaatgtccgtgccttcatgaatgtgaagcactggccctggatgaagctgtatttcaagatcaaacccctcctcaaaagtgcagagacagagaaggagatggccaacatgaaggaagaatttgagaaaaccaaagaagagctggctaagaccgaggcaaaaaggaaagagctggaagaaaaaatggttactctgatgcaagaaaaaaatgacttgcaactccaggttcaagctgaagctgacagcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcgggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaaggatctttggaacaagaaaagaaaatccggatggatctagaaagagcaaagagaaaactagagggagacctaaaattggctcaagaatccacaatggatatagaaaatgacaaacaacaacttgatgaaaagcttaaaaagaaagagtttgaaatgagcggtctgcaaagcaagattgaagatgaacaagcccttggtatgcagctgcagaagaaaatcaaggagttacaagcccgcattgaggagctggaggaggaaatcgaggcagagcgggcctcccgggccaaagcagagaagcagcgctctgatctctcccgggagctggaggagatcagcgagaggctggaagaagccggtggggccacctcagcccagattgagatgaacaagaagcgggaggctgagttccagaaaatgcgcagggacctggaggaggccaccctacagcatgaagccacggcggccaccctgaggaagaagcatgcagatagtgtggccgagcttggggagcagattgacaacctgcagcgagtgaagcagaagctggagaaggagaagagtgagatgaagatggagatcgatgaccttgctagtaacatggagactgtctccaaagccaagggaaaccttgaaaagatgtgccgcgctctagaagatcaactgagtgaaattaagaccaaggaagaggagcagcagcggctgatcaatgacctcacagcacagagagcgcgcctgcaaacagaatcaggtgaatattcacgccagctagatgaaaaggacacactagtttcacagctctcgaggggcaaacaagcctttacacaacagattgaggaactgaaaaggcaacttgaagaggagataaaggccaagagtgccctggcacatgccctgcagtcctcccgccatgactgtgacctgctgcgggaacagtatgaggaggagcaggaagccaaggccgagctacagagagcaatgtccaaggccaacagtgaggttgcccagtggaggaccaaatatgagacagatgccatccagcgcacagaggagctggaggaggccaagaagaagctggctcagcgtctgcaggatgctgaggaacatgtagaagctgtgaatgccaaatgtgcttcccttgagaagacgaagcagaggctccagaatgaagttgaggacctcatgattgatgttgagaggacaaatgctgcctgtgccgccctggacaaaaagcaaaggaactttgataagatcctggcagaatggaaacagaagtgtgaagaaactcatgctgaacttgaagcttctcaaaaggaatcccgctcactcagcacagaactatttaagattaagaatgcttatgaggaatctttagaccaacttgaaaccttgaaacgggaaaataagaatttgcaacaggagatttctgatctcactgaacagattgcagaaggaggaaagcgcatccatgaactggaaaaaataaagaagcaagttgagcaagaaaagtctgaacttcaggctgccttagaggaggcagaggcatctcttgaacatgaagagggaaagatcctgcgcatccagcttgagttgaaccaagtcaagtctgaggttgataggaaaattgctgaaaaagatgaggaaattgaccagatgaagagaaaccacattagaatcgtggagtccatgcagagcacactggatgctgagatcaggagcaggaatgatgccattaggctcaagaagaagatggagggagacctcaatgaaatggaaatccagctgaaccatgccaaccgcatggctgctgaggccctgaggaactataggaacacccaagccatcctcaaggatacccagctccacctggatgatgctctccggagccaggaggacctgaaggaacagctggctatggtggagcgcagagccaacctgctgcaggctgagatcgaggagctgcgggccactctggaacagacagagaggagcaggaaaatcgcagaacaggagctcctggatgccagtgagcgtgttcagctcctgcacacccagaacaccagcctgatcaacaccaagaagaagctggagacagacatttcccaaatccagggagagatggaagacatcatccaggaagcccgcaatgcagaagagaaggccaagaaggccatcactgatgctgccatgatggctgaggagctgaagaaggaacaggacaccagcgcccatctggagcggatgaagaagaacctggaacagacggtgaaggacctgcagcatcgtctggatgaggctgagcagctggccctgaagggtgggaagaagcagatccagaaactggaggccagggttcgtgaacttgaaggtgaagttgaaagtgaacagaagcgcaatgttgaagctgtcaagggtctacgcaaacatgagagaaaagtgaaggaactcacttaccaaactgaggaagaccgcaagaatattctcaggctccaggacctggtggacaaactgcaagcaaaggtgaaatcctacaagagacaagctgaagaagcggaggaacaatccaacgtcaacctctccaaattccgcaggatccagcacgagctggaggaggccgaggaacgggctgacattgctgagtcccaggtcaacaagctgagggtgaagagcagggaggttcacacaaaaatcataagtgaagagtaatttatctaactgctgaaaggtgaccaaagaaatgcacaaaatgtgaaaatctttgtcactccattttgtacttatgacttttggagataaaaaatttatctgccaaaaa

SEQ ID NO: 156948 - DNA, 7662 bp, Homo sapiens
  Payload ID: 10757
  Gene Symbol: MYH10
  Gene Name: myosin, heavy chain 10, non-muscle
  Uniprot ID: P35580
  ENST ID: ENST00000269243
  CDS Start-End: 140-6070
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaacggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccatcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaa

SEQ ID NO: 156949 - DNA, 7762 bp, Homo sapiens
  Payload ID: 10757
  Gene Symbol: MYH10
  Gene Name: myosin, heavy chain 10, non-muscle
  Uniprot ID: P35580
  ENST ID: ENST00000360416
  CDS Start-End: 140-6163
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctcaggaatcgcctaaaccagtgaaacaccagggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgagattcagaatattcagagagcttctttctatgacagtgtttctggtcttcatgagccaccagtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaacggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccatcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtggaa

SEQ ID NO: 156950 - DNA, 7694 bp, Homo sapiens
  Payload ID: 10757
  Gene Symbol: MYH10
  Gene Name: myosin, heavy chain 10, non-muscle
  Uniprot ID: P35580
  ENST ID: ENST00000379980
  CDS Start-End: 140-6097
agcagtgctaaaggagcccggcggaggcagcggtgggtttgggactgaggcgctggatctgtggtcgcggctggggacgtgcgcccgcgccaccatcttcggctgaagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatacaaagaaagttattcagtaccttgcccatgttgcttcttcacataaaggaagaaaggaccataatattcctgaatcgcctaaaccagtgaaacaccagggggaacttgaacggcagcttttgcaagcaaatccaattctggaatcatttggaaatgcgaagactgtgaaaaatgataactcatctcgttttggcaaatttattcggatcaactttgatgtaactggctatatcgttggggccaacattgaaacataccttctggaaaagtctcgtgctgttcgtcaagcaaaagatgaacgtacttttcatatcttttaccagttgttatctggagcaggagaacacctaaagtctgatttgcttcttgaaggatttaataactacaggtttctctccaatggctatattcctattccgggacagcaagacaaagataatttccaggagaccatggaagcaatgcacataatgggcttctcccatgaagagattctgtcaatgcttaaagtagtatcttcagtgctacagtttggaaatatttctttcaaaaaggagagaaatactgatcaagcttccatgccagaaaatacagttgcgcagaagctctgccatcttcttgggatgaatgtgatggagtttactcgggccatcctgactccccggatcaaggtcggccgagactatgtgcaaaaagcccagaccaaagaacaggcagattttgcagtagaagcattggcaaaagctacctatgagcggctctttcgctggctcgttcatcgcatcaataaagctctggataggaccaaacgtcagggagcatctttcattggaatcctggatattgctggatttgaaatttttgagctgaactcctttgaacaactttgcatcaactacaccaatgagaagctgcagcagctgttcaaccacaccatgtttatcctagaacaagaggaataccagcgcgaaggcatcgagtggaacttcatcgatttcgggctggatctgcagccatgcatcgacctaatagagagacctgcgaaccctcctggtgtactggcccttttggatgaagaatgctggttccctaaagccacagataaaacctttgttgaaaaactggttcaagagcaaggttcccactccaagtttcagaaacctcgacaattaaaagacaaagctgatttttgcattatacattatgcagggaaggtggactataaggcagatgagtggctgatgaagaatatggaccccctgaatgacaacgtggccacccttttgcaccagtcatcagacagatttgtggcagagctttggaaagatgtggaccgtatcgtgggtctggatcaagtcactggtatgactgagacagcttttggctccgcatataaaaccaagaagggcatgtttcgtaccgttgggcaactctacaaagaatctctcaccaagctgatggcaactctccgaaacaccaaccctaactttgttcgttgtatcattccaaatcacgagaagagggctggaaaattggatccacacctagtcctagatcagcttcgctgtaacggtgtcctggaagggatccgaatctgtcgccagggcttccctaaccgaatagttttccaggaattcagacagagatatgagatcctaactccaaatgctattcctaaaggttttatggatggtaaacaggcctgtgaacgaatgatccgggctttagaattggacccaaacttgtacagaattggacagagcaagatatttttcagagctggagttctggcacacttagaggaagaaagagatttaaaaatcaccgatatcattatcttcttccaggccgtttgcagaggttacctggccagaaaggcctttgccaagaagcagcagcaactaagtgccttaaaggtcttgcagcggaactgtgccgcgtacctgaaattacggcactggcagtggtggcgagtcttcacaaaggtgaagccgcttctacaagtgactcgccaggaggaagaacttcaggccaaagatgaagagctgttgaaggtgaaggagaagcagacgaaggtggaaggagagctggaggagatggagcggaagcaccagcagcttttagaagagaagaatatccttgcagaacaactacaagcagagactgagctctttgctgaagcagaagagatgagggcaagacttgctgctaaaaagcaggaattagaagagattctacatgacttggagtctagggttgaagaagaagaagaaagaaaccaaatcctccaaaatgaaaagaaaaaaatgcaagcacatattcaggacctggaagaacagctagacgaggaggaaggggctcggcaaaagctgcagctggaaaaggtgacagcagaggccaagatcaagaagatggaagaggagattctgcttctcgaggaccaaaattccaagttcatcaaagaaaagaaactcatggaagatcgcattgctgagtgttcctctcagctggctgaagaggaagaaaaggcgaaaaacttggccaaaatcaggaataagcaagaagtgatgatctcagatttagaagaacgcttaaagaaggaagaaaagactcgtcaggaactggaaaaggccaaaagaaaactcgacggggagacgaccgacctgcaggaccagatcgcagagctgcaggcgcagattgatgagctcaagctgcagctggccaagaaggaggaggagctgcagggcgcactggccagaggtgatgatgaaacactccataagaacaatgcccttaaagttgtgcgagagctacaagcccaaattgctgaacttcaggaagactttgaatccgagaaggcttcacggaacaaggccgaaaagcagaaaagggacttgagtgaggaactggaagctctgaaaacagagctggaggacacgctggacaccacggcagcccagcaggaactacgtacaaaacgtgaacaagaagtggcagagctgaagaaagctcttgaggaggaaactaagaaccatgaagctcaaatccaggacatgagacaaagacacgcaacagccctggaggagctctcagagcagctggaacaggccaagcggttcaaagcaaatctagagaagaacaagcagggcctggagacagataacaaggagctggcgtgtgaggtgaaggtcctgcagcaggtcaaggctgagtctgagcacaagaggaagaagctcgacgcgcaggtccaggagctccatgccaaggtctctgaaggcgacaggctcagggtggagctggcggagaaagcaagtaagctgcagaatgagctagataatgtctccacccttctggaagaagcagagaagaagggtattaaatttgctaaggatgcagctagtcttgagtctcaactacaggatacacaggagcttcttcaggaggagacacgccagaaactaaacctgagcagtcggatccggcagctggaagaggagaagaacagtcttcaggagcagcaggaggaggaggaggaggccaggaagaacctggagaagcaagtgctggccctgcagtcccagttggctgataccaagaagaaagtagatgacgacctgggaacaattgaaagtctggaagaagccaagaagaagcttctgaaggacgcggaggccctgagccagcgcctggaggagaaggcactggcgtatgacaaactggagaagaccaagaaccgcctgcagcaggagctggacgacctcacggtggacctggaccaccagcgccaggtcgcctccaacttggagaagaagcagaagaagtttgaccagctgttagcagaagagaagagcatctctgctcgctatgccgaagagcgggaccgggccgaagccgaggccagagagaaagaaaccaaagccctgtcactggcccgggccctcgaggaagccctggaggccaaggaggagtttgagaggcagaacaagcagctccgagcagacatggaagacctcatgagctccaaagatgatgtgggaaaaaacgttcacgaacttgaaaaatccaaacgggccctagagcagcaggtggaggaaatgaggacccagctggaggagctggaagacgaactccaggccacggaagatgccaagcttcgtctggaggtcaacatgcaggccatgaaggcgcagttcgagagagacctgcaaaccagggatgagcagaatgaagagaagaagcggctgctgatcaaacaggtgcgggagctcgaggcggagctggaggatgagaggaaacagcgggcgcttgctgtagcttcaaagaaaaagatggagatagacctgaaggacctcgaagcccaaatcgaggctgcgaacaaagctcgggatgaggtgattaagcagctccgcaagctccaggctcagatgaaggattaccaacgtgaattagaagaagctcgtgcatccagagatgagatttttgctcaatccaaagagagtgaaaagaaattgaagagtctggaagcagaaatccttcaattgcaggaggaacttgcctcatctgagcgagcccgccgacacgccgagcaggagagagatgagctggcggacgagatcaccaacagcgcctctggcaagtccgcgctgctggatgagaagcggcgtctggaagctcggatcgcacagctggaggaggagctggaagaggagcagagcaacatggagctgctcaacgaccgcttccgcaagaccactctacaggtggacacactgaacgccgagctagcagccgagcgcagcgccgcccagaagagtgacaatgcacgccagcaactggagcggcagaacaaggagctgaaggccaagctgcaggaactcgagggtgctgtcaagtctaagttcaaggccaccatctcagccctggaggccaagattgggcagctggaggagcagcttgagcaggaagccaaggaacgagcagccgccaacaaattagtccgtcgcactgagaagaagctgaaagaaatcttcatgcaggttgaggatgagcgtcgacacgcggaccagtataaagagcagatggagaaggccaacgctcggatgaagcagcttaaacgccagctggaggaagcagaagaagaagcgacgcgtgccaacgcatctcggcgtaaactccagcgggaactggatgatgccaccgaggccaacgagggcctgagccgcgaggtcagcaccctgaagaaccggctgaggcggggtggccccatcagcttctcttccagccgatctggccggcgccagctgcaccttgaaggagcttccctggagctctccgacgatgacacagaaagtaagaccagtgatgtcaacgagacgcagccaccccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccatcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaagtgccttagacactacagtactaagacaatgttgaatatatcattcgcctctataacaatttaatgtattcagttttgactgtgcttcatatcatgtacctctctagtcaaagtggtattacagacattcagtgacaatgaatcagtgttaattctaaatccttgatcctctgcaatgtgcttgaaaacacaaaccttttgggttaaaagctttaacatctattaggaagaatttgtcctgtgggtttggaatcttggattttccccctttatgaactgtactggctgttgaccaccagacacctgaccgcaaatatcttttcttgtattcccatatttctagacaatgatttttgtaagacaataaatttattcattatagatatttgcgcctgctctgtttacttgaagaaaaaagcacccgtggagaataaagagacctcaataaacaagaataatcatgtgaacgtgg

SEQ ID NO: 156951 - DNA, 732 bp, Homo sapiens
  Payload ID: 10757
  Gene Symbol: MYH10
  Gene Name: myosin, heavy chain 10, non-muscle
  ENST ID: ENST00000411957
  CDS Start-End: 170-732
ctgaggcgctggatctgtggtcgcggctggggacgtgcgcccgcgccaccatcttcggctgaagtaactgagggcaaacccatcagacaaccagagccataatttgtggtcaccgctgaaatttaccttggaaactcgaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaagatcgtgaggaccagtcaattctttgcacgggtgagtcaggtgctgggaagacagaaaatac

SEQ ID NO: 156952 - DNA, 6029 bp, Homo sapiens
  Payload ID: 10758
  Gene Symbol: MYH11
  Gene Name: myosin, heavy chain 11, smooth muscle
  Uniprot ID: P35749
  ENST ID: ENST00000300036
  CDS Start-End: 111-6029
gcagggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataa

SEQ ID NO: 156953 - DNA, 6847 bp, Homo sapiens
  Payload ID: 10758
  Gene Symbol: MYH11
  Gene Name: myosin, heavy chain 11, smooth muscle
  Uniprot ID: P35749
  ENST ID: ENST00000396324
  CDS Start-End: 89-6028
gcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgctt

SEQ ID NO: 156954 - DNA, 6886 bp, Homo sapiens
  Payload ID: 10758
  Gene Symbol: MYH11
  Gene Name: myosin, heavy chain 11, smooth muscle
  Uniprot ID: P35749
  ENST ID: ENST00000452625
  CDS Start-End: 89-5926
gcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgctt

SEQ ID NO: 156955 - DNA, 6272 bp, Homo sapiens
  Payload ID: 10758
  Gene Symbol: MYH11
  Gene Name: myosin, heavy chain 11, smooth muscle
  Uniprot ID: P35749
  ENST ID: ENST00000576790
  CDS Start-End: 111-5927
gcagggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgta

SEQ ID NO: 156956 - DNA, 6886 bp, Homo sapiens; identical to SEQ ID NO: 156954
  Payload ID: 10758
  Gene Symbol: MYH11
  Gene Name: myosin, heavy chain 11, smooth muscle
  Uniprot ID: P35749
  ENST ID: ENST00000612165
  CDS Start-End: 89-5926

SEQ ID NO: 156957 - DNA, 6847 bp, Homo sapiens; identical to SEQ ID NO: 156953
  Payload ID: 10758
  Gene Symbol: MYH11
  Gene Name: myosin, heavy chain 11, smooth muscle
  Uniprot ID: P35749
  ENST ID: ENST00000621545
  CDS Start-End: 89-6028

SEQ ID NO: 156958 - DNA, 6272 bp, Homo sapiens; identical to SEQ ID NO: 156955
  Payload ID: 10758
  Gene Symbol: MYH11
  Gene Name: myosin, heavy chain 11, smooth muscle
  Uniprot ID: P35749
  ENST ID: ENST00000616422
  CDS Start-End: 111-5927

SEQ ID NO: 156959 - DNA, 6941 bp, Homo sapiens
  Payload ID: 10758
  Gene Symbol: MYH11
  Gene Name: myosin, heavy chain 11, smooth muscle
  ENST ID: ENST00000618564
  CDS Start-End: 108-6197
gggagatttggacgctccggcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacggagggaccgtctttttggcgaggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgccgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggcccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaa

SEQ ID NO: 156960 - DNA, 6941 bp, Homo sapiens; identical to SEQ ID NO: 156959
  Payload ID: 10758
  Gene Symbol: MYH11
  Gene Name: myosin, heavy chain 11, smooth muscle
  ENST ID: ENST00000616439
  CDS Start-End: 108-6197

SEQ ID NO: 156961 - DNA, 6029 bp, Homo sapiens; identical to SEQ ID NO: 156952
  Payload ID: 10758
  Gene Symbol: MYH11
  Gene Name: myosin, heavy chain 11, smooth muscle
  Uniprot ID: P35749
  ENST ID: ENST00000634050
  CDS Start-End: 111-6029

SEQ ID NO: 156962 - DNA, 5992 bp, Homo sapiens
  Payload ID: 10759
  Gene Symbol: MYH13
  Gene Name: myosin, heavy chain 13, skeletal muscle
  Uniprot ID: Q9UKX3
  ENST ID: ENST00000252172
  CDS Start-End: 91-5907
aaattgctgtgaccgcagcatctctaggaagacgctttattcctgaaggacactgactgtcacttgggaaccaagaagccctctgcagtcatgagctctgacgcagaaatggccatttttggagaagcagctccctacctccggaaaccagagaaggagagaatcgaggctcaaaatcgtccattcgattccaagaaagcctgctttgtagcggataataaggaaatgtatgtgaaaggcatgatccagactagggaaaatgacaaagtcatagtcaagaccctcgatgaccggatgctcactctgaacaatgaccaggtcttccccatgaaccctcccaaatttgacaagatcgaggacatggccatgatgactcacctgcatgaacctgctgttctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgctgactgatcgagacaaccagtctatcctcatcaccggagaatccggggctgggaagactgtgaacaccaagcgtgtcatccagtattttgcaacaattgcagttaccggggacaagaagaaggagacacagccaggcaaaatgcagggaaccctagaggatcagatcatccaggccaacccactgctggaggcctttggaaatgccaagactgtgaggaatgacaactcctcaagatttgggaagttcattcggattcattttggagccacaggaaagctggcatcggcagacatcgaaacttatctgttagaaaaatccagagtgacgtttcaattatccagtgagagaagctatcatattttctaccaaattatgtcaaacaagaagccagaactaattgacctgcttctgatctccaccaaccccttcgacttccccttcgtgagccaaggagaggtcacggtagccagtatcgatgacagtgaagaactgctggcgacagataatgccattgacatcctgggcttcagctcagaggagaaagtcgggatctacaaactgacgggagccgtgatgcattatgggaacatgaagttcaagcagaagcagcgtgaggagcaggcggagccagacggcaccgaagtggctgacaaagccggatacctgatgggactgaattctgcagaaatgctgaagggcctgtgctgtccaagggtgaaggttggcaatgaatatgtcactaaagggcaaaatgtccagcaggtgaccaattcggtgggtgctctggccaaagccgtctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaatgagaaactgcaacagtttttcaaccaccacatgttcgtgctggagcaggaagagtacaagaaggaaggcatcgagtgggagttcattgacttcggaatggacctggctgcctgcatcgagctcatcgagaagcctatgggcatcttctccatcctggaagaggagtgcatgttccccaaggcaacagacacctccttcaagaacaagctgtatgaccagcatcttggaaaatccaacaacttccagaagcccaagcctgccaaaggcaaggctgaggctcacttctcgctggtgcactatgccggcaccgtggactacaacatcgccggctggctggacaaaaacaaggaccccctgaacgagactgtggtggggctgtaccagaagtcttcgctgaagcttctctccttccttttttccaactatgctggtgcagagacaggcgactccggaggaagcaagaagggcgggaagaagaagggctcctctttccagaccgtgtcggccgtgttcagggaaaatttaaacaaattgatgactaacttaaggagcacccaccctcactttgtacgatgtctgattcccaatgagaccaagactcctggtgtgatggaccactacttggtcatgcaccagctgcgctgtaacggggtcctcgagggcatccggatttgcaggaagggattccccagccggatcctctatgctgacttcaagcagcggtaccggatcctcaatgccagtgctatccctgaagggcagttcattgacagcaaaaatgcctcagagaagctcctcaactccatcgatgtggaccgggagcagttcaggttcggcaacaccaaggtgtttttcaaagctgggctcctgggacttttggaggagatgagagatgagaagctggtgacgctgatgacaagcacgcaggcggtgtgcagggggtacctgatgcgggtggagttcaagaagatgatggagaggagggactccatcttctgcatccagtacaacatccgctcttttatgaacgtcaagcactggccctggatgaacctgttcttcaaaatcaagcccctgctgaagagtgcagaggccgagaaggagatggccaccatgaaggaagactttgagaggaccaaggaagaactggcccgatctgaggctcgccggaaggagctggaggagaaaatggtctccctcctgcaggagaagaatgacctccaattgcaggtccagtctgaaacagaaaatctgatggacgctgaggaacggtgtgaaggactcatcaaaagcaagatcctactggaagcaaaagtcaaggagctgacggagagattggaagaggaagaggagatgaattctgaattggttgccaagaagaggaatctggaagataaatgctcctctctcaagagagacattgatgacctggagctgaccttgacgaaagttgaaaaggagaagcatgccacagagaacaaggtaaagaatctttccgaagaaatgacagcacttgaagaaaacatttccaaattgaccaaagaaaagaaatctctacaggaggcccatcagcaaacactggatgatcttcaggtggaagaagataaagtcaatggtctaatcaaaataaatgccaagcttgaacagcaaacagatgatcttgagggttccttagagcaggagaagaaactgcgggcggacttggaaagggcgaagaggaagctggaaggagatctgaaaatgtcccaggaatccattatggatctagaaaatgacaagcagcaaatagaagagaaattgaaaaagaaggagtttgaactcagtcagttacaagccaaaatagatgacgaacaagtccacagtttgcagtttcaaaagaagattaaagaactgcaagcccgcatagaagagctggaggaggaaattgaagcggaacacacgctcagagccaagattgagaagcagcgctcagatctggccagggaactggaggagatcagcgagaggctggaagaagccagtggggccacttcagcccagattgagatgaacaagaagagggaggctgagttccagaaaatgcgcagggacctggaggaggccaccctgcagcacgaagccacagcagccaccctgaggaagaagcaagcagatagtgtggccgagcttggggagcagattgacaacctgcagcgggtgaagcagaagctggagaaggagaagagcgagctgaagatggagattgacgacatggccagcaacatcgaggctctctccaagtcaaagagtaacatagaaagaacgtgccggacggtagaagatcaatttagtgaaatcaaagccaaggacgagcaacagacacagttgatccatgatctgaacatgcagaaagcaagactgcagacccaaaatggggagctgagccaccgagtggaagagaaggagtctctgatttcacagctgaccaaaagcaagcaggccctcacccagcagctggaggagcttaagaggcaaatggaagaagaaaccaaggccaagaacgccatggcgcacgccctgcagtcctcccgccacgactgtgacctgctgcgggaacagtatgaggaggagcaggaagccaaggccgagctgcagagggcgctgtccaaggccaacagtgaggttgcccagtggaggaccaaatacgagacggacgccattcagcgcacagaggagctggaggaggccaagaaaaaactggcccagaggctccaggaagcagaggagaacacggagacggcgaactccaagtgcgcatcgttggagaaaaccaagcagaggctgcagggagaggtggaggatctgatgcgggatctggagcgctcccacaccgcctgtgccacactggacaagaagcagaggaacttcgacaaggtccttgcagagtggaagcaaaagctggacgaaagccaggctgagttggaagctgctcagaaggagtccaggtcactcagcactgaactcttcaagatgaggaatgcctatgaggaggtggtggaccagttagagacactgaggcgagagaacaaaaatctgcaagaagagatttccgacttaactgagcagattgcagaaactggcaagaatcttcaggaagcggaaaagaccaagaagctagtggagcaggaaaagtcagatctgcaggtcgccttagaagaagtggagggttccttggaacacgaggagagcaagatcttgcgcgtgcagctagagctgagccaggtgaaatccgagctagaccgcaaggtcattgagaaggatgaagaaatcgagcagctaaaaagaaacagccagcgggcagcagaggccctgcagagcgtgctggatgctgaaatccgcagccggaacgacgccctgaggctaaagaagaagatggagggagaccttaatgagatggagattcagctgggccactccaaccgccagatggcagagacccagaagcatctgcgcacggtccagggccagctcaaggactcccagctgcatctcgatgacgccctgaggagcaatgaggacctcaaggagcagctggccatcgtggagcgcaggaatggcctcctgctggaggagctggaggaaatgaaggtggccctggaacagacggagcggacccgcaggctgtcagagcaggagctgctggacgccagcgaccgcgtgcagctcctgcactcccagaacacaagcctgataaataccaagaaaaaactggaggctgacatagctcagtgccaggcagaggtggagaactcgatccaggagtccaggaacgcagaggagaaggccaagaaggccatcacggatgctgccatgatggctgaggagctaaagaaggaacaggacaccagcgcccacctggagcggatgaagaagaacctggagcagacggtgaaggacctgcagcaccgtctagatgaggctgaacaactggcgctgaagggcgggaagaagcagatccagaaactggagaaccgggtgcgggagctggaaaatgagcttgatgtggaacagaagaggggagctgaagccctgaagggagcccacaagtacgaacgcaaagtcaaggagatgacttaccaggctgaggaggaccacaagaatatccttaggctccaggacctggtggacaagctgcaggccaaagtgaagtcttacaagaggcaggctgaggaggcggaggagcaggccaacacgcagctgtccagatgccggagagtccagcatgagctagaggaggccgcggagagggcggacatcgctgagtcccaggtcaacaagctgagggccaagagccgagacgtgggcagccagaagatggaagaatgaggctcacctgatgctcgttgccatgggacacctccgagagagtggagggaaaatgtgtgagaaataaattctcctaaatactcgg

SEQ ID NO: 156963 - DNA, 6296 bp, Homo sapiens
  Payload ID: 10759
  Gene Symbol: MYH13
  Gene Name: myosin, heavy chain 13, skeletal muscle
  Uniprot ID: Q9UKX3
  ENST ID: ENST00000418404
  CDS Start-End: 165-5981
gagagatcagggctacgacgcatttacatctaacaagtaaatggtgctcccccaaatatagccaagttagagtgctgggctggcagatttgggagtataaagagagctggggggtcacactcctgaaattgctgtgaccgcagcatctctagccctctgcagtcatgagctctgacgcagaaatggccatttttggagaagcagctccctacctccggaaaccagagaaggagagaatcgaggctcaaaatcgtccattcgattccaagaaagcctgctttgtagcggataataaggaaatgtatgtgaaaggcatgatccagactagggaaaatgacaaagtcatagtcaagaccctcgatgaccggatgctcactctgaacaatgaccaggtcttccccatgaaccctcccaaatttgacaagatcgaggacatggccatgatgactcacctgcatgaacctgctgttctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgctgactgatcgagacaaccagtctatcctcatcaccggagaatccggggctgggaagactgtgaacaccaagcgtgtcatccagtattttgcaacaattgcagttaccggggacaagaagaaggagacacagccaggcaaaatgcagggaaccctagaggatcagatcatccaggccaacccactgctggaggcctttggaaatgccaagactgtgaggaatgacaactcctcaagatttgggaagttcattcggattcattttggagccacaggaaagctggcatcggcagacatcgaaacttatctgttagaaaaatccagagtgacgtttcaattatccagtgagagaagctatcatattttctaccaaattatgtcaaacaagaagccagaactaattgacctgcttctgatctccaccaaccccttcgacttccccttcgtgagccaaggagaggtcacggtagccagtatcgatgacagtgaagaactgctggcgacagataatgccattgacatcctgggcttcagctcagaggagaaagtcgggatctacaaactgacgggagccgtgatgcattatgggaacatgaagttcaagcagaagcagcgtgaggagcaggcggagccagacggcaccgaagtggctgacaaagccggatacctgatgggactgaattctgcagaaatgctgaagggcctgtgctgtccaagggtgaaggttggcaatgaatatgtcactaaagggcaaaatgtccagcaggtgaccaattcggtgggtgctctggccaaagccgtctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaatgagaaactgcaacagtttttcaaccaccacatgttcgtgctggagcaggaagagtacaagaaggaaggcatcgagtgggagttcattgacttcggaatggacctggctgcctgcatcgagctcatcgagaagcctatgggcatcttctccatcctggaagaggagtgcatgttccccaaggcaacagacacctccttcaagaacaagctgtatgaccagcatcttggaaaatccaacaacttccagaagcccaagcctgccaaaggcaaggctgaggctcacttctcgctggtgcactatgccggcaccgtggactacaacatcgccggctggctggacaaaaacaaggaccccctgaacgagactgtggtggggctgtaccagaagtcttcgctgaagcttctctccttccttttttccaactatgctggtgcagagacaggcgactccggaggaagcaagaagggcgggaagaagaagggctcctctttccagaccgtgtcggccgtgttcagggaaaatttaaacaaattgatgactaacttaaggagcacccaccctcactttgtacgatgtctgattcccaatgagaccaagactcctggtgtgatggaccactacttggtcatgcaccagctgcgctgtaacggggtcctcgagggcatccggatttgcaggaagggattccccagccggatcctctatgctgacttcaagcagcggtaccggatcctcaatgccagtgctatccctgaagggcagttcattgacagcaaaaatgcctcagagaagctcctcaactccatcgatgtggaccgggagcagttcaggttcggcaacaccaaggtgtttttcaaagctgggctcctgggacttttggaggagatgagagatgagaagctggtgacgctgatgacaagcacgcaggcggtgtgcagggggtacctgatgcgggtggagttcaagaagatgatggagaggagggactccatcttctgcatccagtacaacatccgctcttttatgaacgtcaagcactggccctggatgaacctgttcttcaaaatcaagcccctgctgaagagtgcagaggccgagaaggagatggccaccatgaaggaagactttgagaggaccaaggaagaactggcccgatctgaggctcgccggaaggagctggaggagaaaatggtctccctcctgcaggagaagaatgacctccaattgcaggtccagtctgaaacagaaaatctgatggacgctgaggaacggtgtgaaggactcatcaaaagcaagatcctactggaagcaaaagtcaaggagctgacggagagattggaagaggaagaggagatgaattctgaattggttgccaagaagaggaatctggaagataaatgctcctctctcaagagagacattgatgacctggagctgaccttgacgaaagttgaaaaggagaagcatgccacagagaacaaggtaaagaatctttccgaagaaatgacagcacttgaagaaaacatttccaaattgaccaaagaaaagaaatctctacaggaggcccatcagcaaacactggatgatcttcaggtggaagaagataaagtcaatggtctaatcaaaataaatgccaagcttgaacagcaaacagatgatcttgagggttccttagagcaggagaagaaactgcgggcggacttggaaagggcgaagaggaagctggaaggagatctgaaaatgtcccaggaatccattatggatctagaaaatgacaagcagcaaatagaagagaaattgaaaaagaaggagtttgaactcagtcagttacaagccaaaatagatgacgaacaagtccacagtttgcagtttcaaaagaagattaaagaactgcaagcccgcatagaagagctggaggaggaaattgaagcggaacacacgctcagagccaagattgagaagcagcgctcagatctggccagggaactggaggagatcagcgagaggctggaagaagccagtggggccacttcagcccagattgagatgaacaagaagagggaggctgagttccagaaaatgcgcagggacctggaggaggccaccctgcagcacgaagccacagcagccaccctgaggaagaagcaagcagatagtgtggccgagcttggggagcagattgacaacctgcagcgggtgaagcagaagctggagaaggagaagagcgagctgaagatggagattgacgacatggccagcaacatcgaggctctctccaagtcaaagagtaacatagaaagaacgtgccggacggtagaagatcaatttagtgaaatcaaagccaaggacgagcaacagacacagttgatccatgatctgaacatgcagaaagcaagactgcagacccaaaatggggagctgagccaccgagtggaagagaaggagtctctgatttcacagctgaccaaaagcaagcaggccctcacccagcagctggaggagcttaagaggcaaatggaagaagaaaccaaggccaagaacgccatggcgcacgccctgcagtcctcccgccacgactgtgacctgctgcgggaacagtatgaggaggagcaggaagccaaggccgagctgcagagggcgctgtccaaggccaacagtgaggttgcccagtggaggaccaaatacgagacggacgccattcagcgcacagaggagctggaggaggccaagaaaaaactggcccagaggctccaggaagcagaggagaacacggagacggcgaactccaagtgcgcatcgttggagaaaaccaagcagaggctgcagggagaggtggaggatctgatgcgggatctggagcgctcccacaccgcctgtgccacactggacaagaagcagaggaacttcgacaaggtccttgcagagtggaagcaaaagctggacgaaagccaggctgagttggaagctgctcagaaggagtccaggtcactcagcactgaactcttcaagatgaggaatgcctatgaggaggtggtggaccagttagagacactgaggcgagagaacaaaaatctgcaagaagagatttccgacttaactgagcagattgcagaaactggcaagaatcttcaggaagcggaaaagaccaagaagctagtggagcaggaaaagtcagatctgcaggtcgccttagaagaagtggagggttccttggaacacgaggagagcaagatcttgcgcgtgcagctagagctgagccaggtgaaatccgagctagaccgcaaggtcattgagaaggatgaagaaatcgagcagctaaaaagaaacagccagcgggcagcagaggccctgcagagcgtgctggatgctgaaatccgcagccggaacgacgccctgaggctaaagaagaagatggagggagaccttaatgagatggagattcagctgggccactccaaccgccagatggcagagacccagaagcatctgcgcacggtccagggccagctcaaggactcccagctgcatctcgatgacgccctgaggagcaatgaggacctcaaggagcagctggccatcgtggagcgcaggaatggcctcctgctggaggagctggaggaaatgaaggtggccctggaacagacggagcggacccgcaggctgtcagagcaggagctgctggacgccagcgaccgcgtgcagctcctgcactcccagaacacaagcctgataaataccaagaaaaaactggaggctgacatagctcagtgccaggcagaggtggagaactcgatccaggagtccaggaacgcagaggagaaggccaagaaggccatcacggatgctgccatgatggctgaggagctaaagaaggaacaggacaccagcgcccacctggagcggatgaagaagaacctggagcagacggtgaaggacctgcagcaccgtctagatgaggctgaacaactggcgctgaagggcgggaagaagcagatccagaaactggagaaccgggtgcgggagctggaaaatgagcttgatgtggaacagaagaggggagctgaagccctgaagggagcccacaagtacgaacgcaaagtcaaggagatgacttaccaggctgaggaggaccacaagaatatccttaggctccaggacctggtggacaagctgcaggccaaagtgaagtcttacaagaggcaggctgaggaggcggaggagcaggccaacacgcagctgtccagatgccggagagtccagcatgagctagaggaggccgcggagagggcggacatcgctgagtcccaggtcaacaagctgagggccaagagccgagacgtgggcagccagaagatggaagaatgaggctcacctgatgctcgttgccatgggacacctccgagagagtggagggaaaatgtgtgagaaataaattctcctaaatactcggattcccggctctgctgtgtttattatcatggtccattcctcttctatgaagctgatatttagattcttgctgctctatcgtaaatataaaataaggaatgtgaaagtggaggatctttgctccaagtagaaaacatggaaatccaacccatggccagattctccttttcatctcatcaccagcccaccccaaatgcctttgacacagtggggttggaaattgaggaggat

SEQ ID NO: 156964 - DNA, 5916 bp, Homo sapiens
  Payload ID: 10759
  Gene Symbol: MYH13
  Gene Name: myosin, heavy chain 13, skeletal muscle
  Uniprot ID: Q9UKX3
  ENST ID: ENST00000621918
  CDS Start-End: 15-5831
agccctctgcagtcatgagctctgacgcagaaatggccatttttggagaagcagctccctacctccggaaaccagagaaggagagaatcgaggctcaaaatcgtccattcgattccaagaaagcctgctttgtagcggataataaggaaatgtatgtgaaaggcatgatccagactagggaaaatgacaaagtcatagtcaagaccctcgatgaccggatgctcactctgaacaatgaccaggtcttccccatgaaccctcccaaatttgacaagatcgaggacatggccatgatgactcacctgcatgaacctgctgttctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgctgactgatcgagacaaccagtctatcctcatcaccggagaatccggggctgggaagactgtgaacaccaagcgtgtcatccagtattttgcaacaattgcagttaccggggacaagaagaaggagacacagccaggcaaaatgcagggaaccctagaggatcagatcatccaggccaacccactgctggaggcctttggaaatgccaagactgtgaggaatgacaactcctcaagatttgggaagttcattcggattcattttggagccacaggaaagctggcatcggcagacatcgaaacttatctgttagaaaaatccagagtgacgtttcaattatccagtgagagaagctatcatattttctaccaaattatgtcaaacaagaagccagaactaattgacctgcttctgatctccaccaaccccttcgacttccccttcgtgagccaaggagaggtcacggtagccagtatcgatgacagtgaagaactgctggcgacagataatgccattgacatcctgggcttcagctcagaggagaaagtcgggatctacaaactgacgggagccgtgatgcattatgggaacatgaagttcaagcagaagcagcgtgaggagcaggcggagccagacggcaccgaagtggctgacaaagccggatacctgatgggactgaattctgcagaaatgctgaagggcctgtgctgtccaagggtgaaggttggcaatgaatatgtcactaaagggcaaaatgtccagcaggtgaccaattcggtgggtgctctggccaaagccgtctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaatgagaaactgcaacagtttttcaaccaccacatgttcgtgctggagcaggaagagtacaagaaggaaggcatcgagtgggagttcattgacttcggaatggacctggctgcctgcatcgagctcatcgagaagcctatgggcatcttctccatcctggaagaggagtgcatgttccccaaggcaacagacacctccttcaagaacaagctgtatgaccagcatcttggaaaatccaacaacttccagaagcccaagcctgccaaaggcaaggctgaggctcacttctcgctggtgcactatgccggcaccgtggactacaacatcgccggctggctggacaaaaacaaggaccccctgaacgagactgtggtggggctgtaccagaagtcttcgctgaagcttctctccttccttttttccaactatgctggtgcagagacaggcgactccggaggaagcaagaagggcgggaagaagaagggctcctctttccagaccgtgtcggccgtgttcagggaaaatttaaacaaattgatgactaacttaaggagcacccaccctcactttgtacgatgtctgattcccaatgagaccaagactcctggtgtgatggaccactacttggtcatgcaccagctgcgctgtaacggggtcctcgagggcatccggatttgcaggaagggattccccagccggatcctctatgctgacttcaagcagcggtaccggatcctcaatgccagtgctatccctgaagggcagttcattgacagcaaaaatgcctcagagaagctcctcaactccatcgatgtggaccgggagcagttcaggttcggcaacaccaaggtgtttttcaaagctgggctcctgggacttttggaggagatgagagatgagaagctggtgacgctgatgacaagcacgcaggcggtgtgcagggggtacctgatgcgggtggagttcaagaagatgatggagaggagggactccatcttctgcatccagtacaacatccgctcttttatgaacgtcaagcactggccctggatgaacctgttcttcaaaatcaagcccctgctgaagagtgcagaggccgagaaggagatggccaccatgaaggaagactttgagaggaccaaggaagaactggcccgatctgaggctcgccggaaggagctggaggagaaaatggtctccctcctgcaggagaagaatgacctccaattgcaggtccagtctgaaacagaaaatctgatggacgctgaggaacggtgtgaaggactcatcaaaagcaagatcctactggaagcaaaagtcaaggagctgacggagagattggaagaggaagaggagatgaattctgaattggttgccaagaagaggaatctggaagataaatgctcctctctcaagagagacattgatgacctggagctgaccttgacgaaagttgaaaaggagaagcatgccacagagaacaaggtaaagaatctttccgaagaaatgacagcacttgaagaaaacatttccaaattgaccaaagaaaagaaatctctacaggaggcccatcagcaaacactggatgatcttcaggtggaagaagataaagtcaatggtctaatcaaaataaatgccaagcttgaacagcaaacagatgatcttgagggttccttagagcaggagaagaaactgcgggcggacttggaaagggcgaagaggaagctggaaggagatctgaaaatgtcccaggaatccattatggatctagaaaatgacaagcagcaaatagaagagaaattgaaaaagaaggagtttgaactcagtcagttacaagccaaaatagatgacgaacaagtccacagtttgcagtttcaaaagaagattaaagaactgcaagcccgcatagaagagctggaggaggaaattgaagcggaacacacgctcagagccaagattgagaagcagcgctcagatctggccagggaactggaggagatcagcgagaggctggaagaagccagtggggccacttcagcccagattgagatgaacaagaagagggaggctgagttccagaaaatgcgcagggacctggaggaggccaccctgcagcacgaagccacagcagccaccctgaggaagaagcaagcagatagtgtggccgagcttggggagcagattgacaacctgcagcgggtgaagcagaagctggagaaggagaagagcgagctgaagatggagattgacgacatggccagcaacatcgaggctctctccaagtcaaagagtaacatagaaagaacgtgccggacggtagaagatcaatttagtgaaatcaaagccaaggacgagcaacagacacagttgatccatgatctgaacatgcagaaagcaagactgcagacccaaaatggggagctgagccaccgagtggaagagaaggagtctctgatttcacagctgaccaaaagcaagcaggccctcacccagcagctggaggagcttaagaggcaaatggaagaagaaaccaaggccaagaacgccatggcgcacgccctgcagtcctcccgccacgactgtgacctgctgcgggaacagtatgaggaggagcaggaagccaaggccgagctgcagagggcgctgtccaaggccaacagtgaggttgcccagtggaggaccaaatacgagacggacgccattcagcgcacagaggagctggaggaggccaagaaaaaactggcccagaggctccaggaagcagaggagaacacggagacggcgaactccaagtgcgcatcgttggagaaaaccaagcagaggctgcagggagaggtggaggatctgatgcgggatctggagcgctcccacaccgcctgtgccacactggacaagaagcagaggaacttcgacaaggtccttgcagagtggaagcaaaagctggacgaaagccaggctgagttggaagctgctcagaaggagtccaggtcactcagcactgaactcttcaagatgaggaatgcctatgaggaggtggtggaccagttagagacactgaggcgagagaacaaaaatctgcaagaagagatttccgacttaactgagcagattgcagaaactggcaagaatcttcaggaagcggaaaagaccaagaagctagtggagcaggaaaagtcagatctgcaggtcgccttagaagaagtggagggttccttggaacacgaggagagcaagatcttgcgcgtgcagctagagctgagccaggtgaaatccgagctagaccgcaaggtcattgagaaggatgaagaaatcgagcagctaaaaagaaacagccagcgggcagcagaggccctgcagagcgtgctggatgctgaaatccgcagccggaacgacgccctgaggctaaagaagaagatggagggagaccttaatgagatggagattcagctgggccactccaaccgccagatggcagagacccagaagcatctgcgcacggtccagggccagctcaaggactcccagctgcatctcgatgacgccctgaggagcaatgaggacctcaaggagcagctggccatcgtggagcgcaggaatggcctcctgctggaggagctggaggaaatgaaggtggccctggaacagacggagcggacccgcaggctgtcagagcaggagctgctggacgccagcgaccgcgtgcagctcctgcactcccagaacacaagcctgataaataccaagaaaaaactggaggctgacatagctcagtgccaggcagaggtggagaactcgatccaggagtccaggaacgcagaggagaaggccaagaaggccatcacggatgctgccatgatggctgaggagctaaagaaggaacaggacaccagcgcccacctggagcggatgaagaagaacctggagcagacggtgaaggacctgcagcaccgtctagatgaggctgaacaactggcgctgaagggcgggaagaagcagatccagaaactggagaaccgggtgcgggagctggaaaatgagcttgatgtggaacagaagaggggagctgaagccctgaagggagcccacaagtacgaacgcaaagtcaaggagatgacttaccaggctgaggaggaccacaagaatatccttaggctccaggacctggtggacaagctgcaggccaaagtgaagtcttacaagaggcaggctgaggaggcggaggagcaggccaacacgcagctgtccagatgccggagagtccagcatgagctagaggaggccgcggagagggcggacatcgctgagtcccaggtcaacaagctgagggccaagagccgagacgtgggcagccagaagatggaagaatgaggctcacctgatgctcgttgccatgggacacctccgagagagtggagggaaaatgtgtgagaaataaattctcctaaatactcgg

SEQ ID NO: 156965 - DNA, 3848 bp, Homo sapiens
  Payload ID: 10760
  Gene Symbol: MYH14
  Gene Name: myosin, heavy chain 14, non-muscle
  ENST ID: ENST00000262269
  CDS Start-End: 101-1627
gaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactgg

SEQ ID NO: 156966 - DNA, 6787 bp, Homo sapiens
  Payload ID: 10760
  Gene Symbol: MYH14
  Gene Name: myosin, heavy chain 14, non-muscle
  Uniprot ID: Q7Z406
  ENST ID: ENST00000376970
  CDS Start-End: 48-6035
ctctttctccccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggacc

SEQ ID NO: 156967 - DNA, 4247 bp, Homo sapiens
  Payload ID: 10760
  Gene Symbol: MYH14
  Gene Name: myosin, heavy chain 14, non-muscle
  ENST ID: ENST00000440075
  CDS Start-End: 2216-4132
ctctttctccccaggccgaagcctcgggacggccctggaagccgaccatggcagccgtgaccatgtcggtgcccgggcggaaggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatgg

SEQ ID NO: 156968 - DNA, 6811 bp, Homo sapiens
  Payload ID: 10760
  Gene Symbol: MYH14
  Gene Name: myosin, heavy chain 14, non-muscle
  Uniprot ID: Q7Z406
  ENST ID: ENST00000425460
  CDS Start-End: 48-6059
ctctttctccccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggacc

SEQ ID NO: 156969 - DNA, 3046 bp, Homo sapiens
  Payload ID: 10760
  Gene Symbol: MYH14
  Gene Name: myosin, heavy chain 14, non-muscle
  ENST ID: ENST00000599920
  CDS Start-End: 39-3046
cccaggccgaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggc

SEQ ID NO: 156970 - DNA, 6896 bp, Homo sapiens
  Payload ID: 10760
  Gene Symbol: MYH14
  Gene Name: myosin, heavy chain 14, non-muscle
  Uniprot ID: Q7Z406
  ENST ID: ENST00000601313
  CDS Start-End: 31-6141
gaagcctcgggacggccctggaagccgaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgaacatgggggcttccagcagttctctttccttggctccttcccaccgtcgcccccaggatctgcagagaggtgcagctctgctatttctccgccaggggtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaatgactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctctctctctctccctccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggaccatc

SEQ ID NO: 156971 - DNA, 6137 bp, Homo sapiens
  Payload ID: 10760
  Gene Symbol: MYH14
  Gene Name: myosin, heavy chain 14, non-muscle
  Uniprot ID: Q7Z406
  ENST ID: ENST00000598205
  CDS Start-End: 126-6137
gacagatgtccctgaaggcccgagggacaccagccgctatgccaggctccaaagaacccgaggcaaaccaacgctggtcccggtctttgaggactccccggcccagtgagggagaccgacagaccatggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccgcctccgtcagcaccgtgtcttatggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtga

SEQ ID NO: 156972 - DNA, 5988 bp, Homo sapiens
  Payload ID: 10760
  Gene Symbol: MYH14
  Gene Name: myosin, heavy chain 14, non-muscle
  Uniprot ID: Q7Z406
  ENST ID: ENST00000596571
  CDS Start-End: 1-5988
atggcagccgtgaccatgtcggtgcccgggcggaaggcgccccccaggccgggcccagtgcccgaggcggcccagccgttcctgttcacgccccgcgggcccagcgcgggtggcgggcctggctcgggcacctccccgcaggtggagtggacggcccggcgtctcgtgtgggtgccttcggagcttcacgggttcgaggcggcggcgctgcgggacgaaggcgaggaggaggcggaggtggagctggcggagagcgggaggcggctgcgactgccgcgggaccagatccagcgcatgaacccgcccaagttcagcaaggccgaggacatggccgagctgacctgcctcaacgaggcctcggtcctgcacaacctccgggagcggtactactccggcctcatctacacgtactccggccttttctgtgtggtcatcaacccgtacaagcagcttcccatctacacagaagccattgtggagatgtaccggggcaagaagcgccacgaggtgccaccccacgtgtacgcagtgaccgagggggcctatcggagcatgctgcaggatcgtgaggaccagtccattctctgcactggagagtctggagctgggaagacggaaaacaccaagaaggtcatccagtacctcgcccacgtggcgtcgtctccaaagggcaggaaggagccgggtgtccccggtgagctggagcggcagctgcttcaggccaaccccatcctagaggcctttggcaatgccaagacagtgaagaatgacaactcctcccgattcggcaaattcatccgcatcaactttgatgttgccgggtacatcgtgggcgccaacattgagacctacctgctggagaagtcgcgggccatccgccaggccaaggacgagtgcagcttccacatcttctaccagctgctggggggcgctggagagcagctcaaagccgacctcctcctcgagccctgctcccactaccggttcctgaccaacgggccgtcatcctctcccggccaggagcgggaactcttccaggagacgctggagtcgctgcgggtcctgggattcagccacgaggaaatcatctccatgctgcggatggtctcagcagttctccagtttggcaacattgccttgaagagagaacggaacaccgatcaagccaccatgcctgacaacacagctgcacagaagctctgccgcctcttgggactgggggtgacggatttctcccgagccttgctcacccctcgcatcaaagttggccgagactatgtgcagaaagcccagactaaggaacaggctgacttcgcgctggaggccctggccaaggccacctacgagcgcctcttccgctggctggttctgcgcctcaaccgggccttggaccgcagcccccgccaaggcgcctccttcctgggcatcctggacatcgcgggctttgagatcttccagctgaactccttcgagcagctctgcatcaactacaccaacgagaagctgcagcagctcttcaaccacaccatgttcgtgctggagcaggaggagtaccagcgtgagggcatcccctggaccttcctcgactttggcctcgacctgcagccctgcatcgacctcatcgagcggccggccaacccccctggactcctggccctgctggatgaggagtgctggttcccgaaggccacagacaagtcgtttgtggagaaggtagcccaggagcagggcggccaccccaagttccagcggccgaggcacctgcgggatcaggccgacttcagtgttctccactacgcgggcaaggtcgactacaaggccaacgagtggctgatgaaaaacatggaccctctgaatgacaacgtcgcagccttgctccaccagagcacagaccggctgacggcagagatctggaaagacgtggagggcatcgtggggctggaacaggtgagcagcctgggcgacggcccaccaggtggccgcccccgtcggggtatgttccggacagtgggacagctctacaaggagtccctgagccgcctcatggccacactcagcaacaccaaccccagttttgtccgctgcattgtccccaaccacgagaagagggccgggaagctggagccacggctggtgctggaccagcttcgctgcaacggggtcctggagggcatccgcatctgtcgccagggcttccccaaccgcatcctcttccaggagttccggcagcgatacgagatcctgacacccaatgccatccccaagggcttcatggatgggaagcaggcctgtgaaaagatgatccaggcgctggaactggaccccaacctctaccgcgtgggacagagcaagatcttcttccgggctggggtcctggcccagctggaagaggagcgagacctgaaggtcaccgacatcatcgtctccttccaggcagctgcccggggatacctggctcgcagggccttccagaagcgccagcagcagcagagcgccctgagggtgatgcagcggaactgcgcggcctacctcaagctgagacactggcagtggtggcggctgtttaccaaggtgaagccactgctgcaggtgacgcggcaggatgaggtgctgcaggcacgggcccaggagctgcagaaagtgcaggagctacagcagcagagcgcccgcgaagttggggagctccagggccgagtggcacagctggaagaggagcgcgcccgcctggcagagcaattgcgagcagaggcagaactgtgtgcagaggccgaggagacgcgggggaggctggcagcccgcaagcaggagctggagctggtggtgtcagagctggaggctcgcgtgggcgaggaggaggagtgcagccgtcaaatgcaaaccgagaagaagaggctgcagcagcacatacaggagctagaggcccaccttgaggctgaggagggtgcgcggcagaagctgcagctggagaaggtgacgacagaggcaaaaatgaagaaatttgaagaggacctgctgctcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcggagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtga

SEQ ID NO: 156973 - DNA, 7074 bp, Homo sapiens
  Payload ID: 10761
  Gene Symbol: MYH15
  Gene Name: myosin, heavy chain 15
  Uniprot ID: Q9Y2K3
  ENST ID: ENST00000273353
  CDS Start-End: 58-5898
catttctacttcatatgatcattttaattgtatttacctcatcttaccaaaaagatcatggttgaatcttgcctactcacgtttagggcctttttttggtggattgctttaataaagatggatctgtcagaccttggagaagccgcagccttcctcagaagaagtgaagctgagctgcttctactacaggccacagccttggatgggaagaagaaatgctggattcctgatggtgagaatgcttatatcgaggctgaggtaaaagggagtgaagatgatggaacagtaattgttgagacagcagatggagagagtctgagcataaaggaggacaaaatccagcagatgaatcctccagagtttgaaatgattgaagacatggcaatgctgactcacctcaatgaggcatccgtgctgcataccctgaagcggcgctatggccagtggatgatctatacatattcaggtctcttctgtgtgaccataaacccttacaaatggcttcccgtgtatcagaaagaagtcatggccgcctacaaagggaagaggcgatcagaggctccccctcacatctttgctgttgccaataacgcctttcaggacatgcttcacaatcgagaaaatcagtctatactcttcacaggagaatctggtgctggaaagactgtgaacagcaaacatattatccagtattttgccaccatagcagccatgattgaatccaggaaaaagcagggggcgttagaagatcaaatcatgcaagcgaatactatcttggaagcatttggaaatgctaaaaccctgagaaatgacaactcctctcgttttggcaaattcatcaggatgcactttggtgccagaggcatgctgtcatctgtggacattgatatctatttgcttgaaaagtccagggtgattttccagcaggctggagagaggaactaccacatattctatcaaattctatctggacaaaaagagcttcatgacctgctcctggtatctgcaaatccctcagacttccacttttgctcctgtggagcagttactgtggagagcttggatgatgctgaagaattgctggccacagaacaagccatggacatcttgggctttcttcctgatgagaagtatggatgctataaactcactggagccatcatgcactttggaaatatgaaatttaaacagaaacctagagaagagcaactggaagcagatggcacagaaaatgctgacaaagctgctttcctcatgggcattaactcctctgagttggtaaagtgcttgatccatcctagaatcaaagttggtaacgaatatgttaccagaggtcaaactatagaacaggtaacctgtgctgtcggtgccctgtccaagtcaatgtatgaaaggatgtttaagtggctagtggcacggatcaacagggccctggatgccaagctgtcaaggcagttcttcattggcattcttgacatcactggttttgaaatccttgagtataatagccttgagcaactttgcattaattttaccaatgaaaaattacaacaattcttcaattggcacatgtttgttctggagcaagaggaatataagaaagaaagcattgaatgggtgtctattggctttggtctggatttgcaagcttgcatagatctcattgagaagccaatgggcatcctttccatccttgaagaagagtgtatgtttcctaaggctacagacctgactttcaagaccaaactctttgacaaccattttggaaagtcggttcatctccagaagcccaagcctgataagaagaaatttgaagctcattttgaacttgtccattatgcaggagtggtaccttataatatcagtggttggctggaaaagaacaaagacctccttaatgaaacagtggtagctgtatttcagaagtcttccaacagactcctggcgagcctttttgaaaattacatgagtactgacagtgctataccatttggggagaagaaacgaaagaaaggagcttcattccaaacggttgcatctctgcataaagaaaacctgaataaattgatgactaatctgaaatcaacagcacctcattttgtgagatgcataaatcccaatgtgaacaaaataccaggtatactggacccttacttggttctacagcagttgcgctgtaatggtgtcttggaagggactaggatatgccgtgaaggttttccaaaccgactgcagtatgctgattttaaacaaaggtactgcattctgaatccaaggacctttccaaagagcaagtttgtgagcagcagaaaagcagctgaagaattacttggctccttggagatagaccatacccagtaccgatttggaatcactaaggtgttttttaaagctgggtttctgggccaactggaagcaataagagatgagagactatctaaagtcttcacattgttccaagccagagcacagggcaaactgatgcgaatcaaattccagaagattctggaagaaagggatgcacttattttgatccaatggaacataagagctttcatggctgtgaagaactggccctggatgaggctcttcttcaagatcaagcctcttgttaaatcttcagaagtaggagaagaagtagctggactgaaggaagagtgtgcacaattacagaaagccttggagaaatcagagtttcagagggaggaactgaaagcaaagcaagtatccctcactcaggaaaaaaatgacctgattcttcagcttcaggctgagcaagagacactggcaaatgttgaagagcagtgcgagtggctgattaaatccaagatccagctggaggccagagtaaaggagctgtcggagagggtggaggaagaagaggagataaattctgagctgactgccagggggcggaaactcgaagatgaatgttttgagttgaagaaagaaatcgatgacctggaaacaatgttggtgaagtcagagaaggagaagcgtactacagagcacaaggtcaagaacttgactgaggaagtagagtttctaaatgaggatatcagcaaacttaacagagcagccaaggttgtgcaggaggcccatcagcagaccctggatgacctgcacatggaggaggagaagctcagcagcctgagcaaagcaaatctgaagctggaacagcaagttgatgagcttgagggtgcccttgagcaggagagaaaagcgagaatgaactgtgaaagggaactgcacaaactggagggcaatttaaagctgaatcgggaaagtatggagaacctggaaagcagccagcgacacctggcagaagagctgaggaaaaaagaattagaattgagtcagatgaattcaaaagtggagaatgagaaaggcctggtagctcagcttcagaagacggttaaagagcttcagactcaaataaaggatttgaaagagaaactagaagctgaaaggaccactcgagccaagatggaaagggagagagctgacctcacccaagacctggctgacttgaatgagaggctggaggaggtaggaggatccagtttggctcagctggaaataactaagaaacaggaaaccaaattccagaagctgcaccgagacatggaagaggccactctgcactttgagacaacttctgcatctttgaagaagagacatgcagacagcctggctgagctcgagggccaggtagaaaatctacagcaggtcaagcagaaactggaaaaagacaagagtgacttgcagctagaagtagatgacctcctgacccgtgttgagcagatgacaagagctaaggcaaatgctgagaaactctgtactctatatgaagagcgcttgcatgaagcaactgcaaagctagataaggtgactcagttggcaaatgacctggcagcacaaaagacaaagctgtggagtgagagtggcgagttcctacggaggcttgaagagaaggaggctctgataaaccaactttccagggaaaagagcaacttcactcggcagattgaagacctgagagggcagctggaaaaggagaccaaatcccagagtgccctggcccatgccctgcagaaggctcagcgtgactgtgaccttctacgagagcagtatgaggaagaacaagaggtcaaggctgagctgcaccggaccttatccaaagtcaatgctgaaatggtgcaatggagaatgaagtatgaaaacaatgtcatccagagaacagaagacttggaggatgccaagaaggaactggcaattagattgcaggaggcagccgaagccatgggggtggccaatgccagaaatgcctccttggagagagccaggcaccagctgcagctggagctcggggacgccctgtctgacctcgggaaggtccgctctgcagcagccaggctggaccagaagcagctgcagtctggcaaggcccttgccgactggaagcagaagcacgaggagtcccaggcgttgctggatgcctctcagaaggaagttcaggctctcagtacagagctcctcaagctcaagaacacctatgaggagagcatcgtgggccaggagacactcaggagggagaacaagaacctccaagaagagatttctaatctgacaaaccaggttagagaagggaccaagaacttaactgaaatggaaaaggtcaagaaactaattgaagaagagaagacagaagtccaggtgacactggaagaaacagagggagccctggaacgtaatgaaagcaagattcttcatttccagcttgaactcttggaagctaaagcagaacttgaaagaaagctttcagagaaagatgaagaaatagaaaattttaggaggaagcagcagtgtaccattgactccctgcagtctagtctggattctgaagctaagagcagaattgaggttacccggctgaagaagaagatggaagaggacctcaatgagatggaactccagcttagctgtgccaaccggcaggtgtcagaagcaaccaaatccctgggccagcttcagattcaaatcaaggaccttcaaatgcagctggatgacagcacacaactgaacagtgatctgaaggagcaggtggctgtggctgagcggcgcaactctcttcttcagtctgaactagaggatctaaggtccctgcaagagcagacagagcgtggccgcaggctgtcagaagaagagctcctggaagcaacagaaagaatcaatcttttctatacccagaacacaagcctcctcagccagaagaagaaactggaggctgatgttgcccggatgcagaaagaagctgaagaggtggtgcaggagtgtcaaaatgcagaagagaaggccaagaaggcagccattgaggcagcaaacttgtcagaagaactgaagaagaagcaagacaccattgcccacttggaaaggacaagagaaaatatggagcagacaattacagacttacagaaaaggctggctgaagctgaacagatggccctgatggggagtagaaagcaaatccagaaactagaatccagggttcgtgaactggaaggtgaactggagggtgaaatccgtcgcagtgcagaggcccagaggggagcccgcagacttgagcgatgcatcaaagagctgacctatcaggcagaggaagacaagaagaatctgagcaggatgcaaactcagatggataaacttcagctaaaagtgcaaaattacaagcagcaagtcgaggtggcggaaacacaagccaatcaatacctttccaagtataagaaacagcaacatgagttgaatgaagtgaaggaaagggcagaggtggcagaatctcaagtcaataaactcaaaattaaagcaagagagtttgggaaaaaggttcaagaagaatagcatcccctgctttgaaaggacaacagctggagaagtacaaggaaggtgctgtttcatggccaaaaacttaggttgcatggaaacatttttaaaaacatgtttaaattgcttttcacaccatataaacaaggcaattagaaaaataattaaagggaatatcattgcttccacagttaatggggattttttgatcctcaaatgcaagtaaactaccttctaatgcttcacatgacagattaaataaatggaagaaccttttcaattctgatgtttaaaaaatgaataaatacttgatcctttgtccatatttcctcttaatgggtaggactcatagaagatgtccttagaccagtcacgcttcatggggactagggcatgttggtgaatggtttttactaaagttaggcaactttggcttgattcacccctaaatctatgaatgtatattgtgagccagcagtggtagaatggaagtcataagatctcctcagcattgtgatataaatatagctatagttaggcaatttgaacatgtaggcaaaactctcctaatcaacacacatgtaggctatatgctggtacatgctttaaacatggaggtaaccccacacgagacattcagtgacaggtaatatgctggatttgtgcagtaccgatttggctcagctggaggaacatgtcccggaattcctctctctcatggttctggattggagtaggtcataaagaaatttgcattaatttgatcagcagctattttatactcataaggtcagtgtacagacccaagcatggtgacagcttgaaaatatgactccaggccaaaaaggggagctagaagagaccagagacagctccctggacccagagctcttccagctcctgccagcctcctccttcagctttgcaaagtactggccaggtgtgtgtgcagctccatggcaaccagcatcagcttttcctgagatcacacacagcattgcagtggaggccgtgagacagacatgggttctgtttgttcttatggacttcccttcatccttgctgcattcacagtcgacctacagtgacttcaggcccagaaccagatgcagagggaacagcctggcctagacttctccaccagcacccacaattgtgtaaggctgaagctctataataaatctttattctgtc

SEQ ID NO: 156974 - DNA, 6339 bp, Homo sapiens
  Payload ID: 10762
  Gene Symbol: MYH2
  Gene Name: myosin, heavy chain 2, skeletal muscle, adult
  Uniprot ID: Q9UKX2
  ENST ID: ENST00000245503
  CDS Start-End: 386-6211
aaaaagaagttccgagggaagccaggtatcctggctgcccagccactgcctttatccaccagcttgactctttcagatcatcttctcaaattatccataggagatttatccacatactcaataagaaaaatatttctaattatatccaaccattcttaatatgaatgagaattatgcggggacgctagattgccaagaggtattttgccaaacaattccttttgacttaagaaagaagaggcagctgcattgtttccatagctatccatataaaagagcccttggaatgaggctgactcgtcctgctttaaaaagctccaagaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaagcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcagagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaggcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaac

SEQ ID NO: 156975 - DNA, 6078 bp, Homo sapiens
  Payload ID: 10762
  Gene Symbol: MYH2
  Gene Name: myosin, heavy chain 2, skeletal muscle, adult
  Uniprot ID: Q9UKX2
  ENST ID: ENST00000397183
  CDS Start-End: 129-5954
aggacgggcctttcaagagggacactggtcacaccgcccagtgtcagcagcagctgctagttctgaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaagcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagagaatttgaacaagctgatgaccaacctcaggagtacccatcctcactttgtgaggtgtatcatccccaatgagacaaaaactcctggtgccatggagcatgagcttgtcctccaccagctgaggtgtaacggtgtgctggaaggcatccgcatctgtaggaaaggatttccaagcagaatcctttatgcagacttcaaacagagatacaaggtattaaatgcaagtgcaatccctgaagggcaattcattgatagcaagaaggcctctgagaagctccttgcatccatcgacattgaccacacccagtataaatttgggcacaccaaggtctttttcaaagctggtcttctggggctcctagaggagatgcgagatgacaagctggcccagctgattacccgaacccaggccaggtgcagagggttcttggcaagagtggagtaccagaggatggtggagagaagggaggccatcttctgtatccagtacaatatcagatccttcatgaatgtcaagcactggccctggatgaaactcttcttcaagatcaagcctctgttgaagagtgcagaaactgagaaggagatggccaccatgaaggaagaatttcagaaaattaaagacgaacttgccaagtcagaggcaaaaaggaaggaactggaagaaaagatggtgacgctgttgaaagaaaaaaatgacttgcagctccaagttcaggctgaagccgaaggcttggctgatgcagaggaaaggtgtgaccagctaatcaaaaccaaaatccagctagaagccaaaatcaaagaggtgactgagagagctgaggatgaggaagagatcaatgctgagctgacagccaagaagaggaaactggaggatgaatgttcagaactcaagaaagacattgatgaccttgagctgacactggccaaggttgagaaggagaaacatgccacagaaaacaaggtgaaaaacctcacagaagagatggcaggtctggatgaaaccattgctaagctgaccaaggagaagaaggctctccaggaggcccaccagcagaccctggatgacctgcaggcagaggaggacaaagtcaacaccctgaccaaagctaaaatcaaacttgaacaacaagtggatgatcttgaagggtccttggagcaagaaaagaaacttcgcatggacctagaaagggctaagaggaaacttgagggtgacttgaagttggcccaagaatccataatggacattgaaaatgagaaacagcaacttgatgaaaagctcaaaaagaaagagtttgaaatcagcaatctgcaaagcaagattgaagatgaacaggcacttggcattcaattgcagaagaaaattaaagaattgcaagcccgcattgaggagctggaggaggaaatcgaggcagagcgggcctcccgggccaaagcagagaagcagcgctctgacctctcccgggagctggaggagatcagcgagaggctggaagaagccggtggggccacttcagcccagattgagatgaacaagaagcgggaggctgagttccagaaaatgcgcagggacctggaggaggccaccctacagcatgaagccacagcggccaccctgaggaagaagcatgcagatagtgtggccgagcttggggagcagattgacaacctgcagcgagtgaagcagaagctggagaaggagaagagtgagatgaagatggagattgatgaccttgctagtaatgtagaaacggtctccaaagccaagggaaacctagagaaaatgtgccggactctagaggaccaactgagtgaactgaaatcaaaggaagaggagcagcagcggctgatcaatgacctgactgcgcagagggggcgcctgcagactgaatctggtgagttttcacgccagcttgatgaaaaggaagctctggtgtctcagttatcaagaggcaaacaagcctttactcaacagattgaagaattaaagaggcaacttgaagaggagataaaagccaagaacgccctggcgcatgccctgcagtcttcccgccacgactgtgacctgctgcgggaacagtatgaggaggagcaggaatccaaggccgagctgcagagagcactgtccaaggccaacaccgaggttgcccaatggaggaccaaatacgagacggacgccatccagcgcacagaggagctggaggaggccaagaagaagctggcccagcggctgcaggcagctgaggaacatgtagaagctgtgaacgccaaatgtgcttccctcgaaaagacgaagcagcggctgcagaatgaggtcgaggacctcatgcttgatgtggagaggacaaatgccgcctgtgccgcccttgacaaaaagcaaaggaacttcgataagatcctggcagaatggaaacagaaatgtgaggaaacgcatgctgagcttgaggcctcccagaaggaggcccgttcccttggcactgagctgttcaagataaagaatgcctatgaggaatctttggatcagctagaaaccctgaagcgagagaacaaaaacttacagcaggagatttctgacctcacggaacagattgcagaaggagggaaacgtatccatgaactggagaaaataaagaaacaagtggaacaagaaaagtgtgaacttcaggctgctttagaagaagcagaggcatctcttgaacatgaagagggaaagatcctgcgcatccagcttgagttgaaccaagtcaagtctgaggttgataggaaaattgctgaaaaagatgaggaaattgaccagctgaagagaaaccacattagaatcgtggagtccatgcagagcacgctggatgctgagatcaggagtaggaatgatgccattaggctcaagaagaagatggagggagacctcaatgaaatggaaatccagctgaaccatgccaaccgcatggctgctgaggccctgaggaactacaggaacacccaaggcatcctcaaggatacccagatccacctggatgatgctctccggagccaggaggacctgaaggaacagctggccatggtggagcgcagagccaacctgctgcaggctgagatcgaggagctgcgggccactctggaacagacagagaggagcagaaaaatcgcagaacaggagctcctggatgccagtgagcgtgttcagctactgcacacccagaacaccagcctgatcaacaccaagaagaagctggagacagatatttcccaaatgcaaggagagatggaggacattctccaggaagcccgcaatgcagaagaaaaggccaagaaggccatcactgatgccgccatgatggctgaggagctgaagaaggagcaggacaccagcgcccacctggagcggatgaagaagaacatggagcagaccgtgaaggatctgcagctccgtctggatgaggctgagcagctggccctgaagggtgggaagaagcagatccagaaactggaggccagggtacgggagctggaaggagaggttgagagtgagcaaaagcgtaatgctgaggctgtcaaaggtctgcgcaaacatgagaggcgagtgaaggaactcacttaccagacggaagaagatagaaagaatattctcaggcttcaagatttggtagataaacttcaggcaaaagtgaaatcttataagagacaagctgaggaggctgaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgc

SEQ ID NO: 156976 - DNA, 675 bp, Homo sapiens
  Payload ID: 10762
  Gene Symbol: MYH2
  Gene Name: myosin, heavy chain 2, skeletal muscle, adult
  ENST ID: ENST00000420805
  CDS Start-End: 129-675
aggacgggcctttcaagagggacactggtcacaccgcccagtgtcagcagcagctgctagttctgaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtg

SEQ ID NO: 156977 - DNA, 2528 bp, Homo sapiens
  Payload ID: 10762
  Gene Symbol: MYH2
  Gene Name: myosin, heavy chain 2, skeletal muscle, adult
  Uniprot ID: Q9UKX2
  ENST ID: ENST00000532183
  CDS Start-End: 270-2396
aggacgggcctttcaagagggacactggtcacaccgcccagtgtcagcagcagctgctagttctggtactgctccttctggaactgcacgttttacctctatgaattttgttacttctgtttacaatagcaagccatgccataaatgggattttttccccctctttttggtcaactaatcaagtgcttttcccttttcttttatagaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaagcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgcaaacaata

SEQ ID NO: 156978 - DNA, 572 bp, Homo sapiens
  Payload ID: 10762
  Gene Symbol: MYH2
  Gene Name: myosin, heavy chain 2, skeletal muscle, adult
  ENST ID: ENST00000578017
  CDS Start-End: 108-572
cacattttattgatttttgttgttgttgtttggtcactcaattaatgtaaacggttatctttcctgtttaccagactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggc

SEQ ID NO: 156979 - DNA, 2379 bp, Homo sapiens
  Payload ID: 10762
  Gene Symbol: MYH2
  Gene Name: myosin, heavy chain 2, skeletal muscle, adult
  Uniprot ID: Q9UKX2
  ENST ID: ENST00000622564
  CDS Start-End: 129-2255
atagctatccatataaaagagcccttggaatgaggctgactcgtcctgctttaaaaagctccaagaactgtctcactcccaggctacatcttctcacttgctaacaaggacctctgagttcagcagccatgagttcagactcagaattggctgtttttggggaggctgctcctttcctccgaaagtctgaaagggagcgcattgaggcccagaataggccctttgatgccaaaacatctgtctttgtggcggagcccaaagaatcctttgtcaaagggaccatccagagcagagaaggaggaaaagtgacggtgaagactgagggaggagcgactctgacagtgaaggatgatcaggtcttccccatgaaccctcccaaatatgacaagatcgaggatatggccatgatgactcatctgcatgagcctgctgtgctgtacaacctcaaagaacgttatgcagcctggatgatctacacctattcaggtctcttctgtgtcactgtcaacccctacaagtggctgcctgtgtataagcccgaggtggtgacagcctaccgaggcaaaaagcgccaggaggccccgccccacatcttctccatctctgacaacgcctatcagttcatgctgactgaccgagagaatcagtcaatcctgatcactggagaatctggtgcagggaagactgtgaacaccaagcgtgtcatccagtactttgcaacaattgcagttactggtgagaagaagaaggaagaaattacttctggcaaaatacaggggactctggaagatcaaatcatcagtgccaaccccctactggaggcctttggcaacgccaagaccgtgaggaatgacaactcctctcgctttggtaaattcatcagaatccactttggcactactggaaaactggcatctgctgatattgaaacatatctgctagagaagtctagagttgttttccagcttaaggctgagagaagttatcatattttttaccagattacatcgaataagaaaccagaacttattgaaatgcttctgattaccacgaacccatatgattacccatttgtcagtcaaggggagatcagtgtggccagcatcgatgatcaggaagaactgatggccacagatagtgctattgatattttgggctttactaatgaagaaaaggtctccatttacaagctcacgggggctgtgatgcattatgggaacctaaaatttaagcaaaagcagcgtgaggagcaagcagagccagatggcacagaagttgctgacaaggcggcctacctccagagtctgaactctgcagatctgctcaaagctctctgctaccccagggtcaaggtcggcaatgagtatgtcaccaaaggccagactgtagaacaggtgtccaacgcagtaggtgctctggccaaagccgtctacgagaagatgttcctgtggatggttgcccgcatcaaccagcagctggacaccaagcagcccaggcagtacttcatcggggtcttggacattgctggttttgagatttttgatttcaacagcctggagcagctgtgcatcaacttcaccaatgagaaactgcaacagtttttcaaccaccacatgttcgtgctggagcaggaggagtacaagaaggaaggcatcgagtggacgttcatcgacttcgggatggacctggctgcctgcatcgagctcatcgagaagcctatgggcatcttctccatcctggaagaggagtgcatgttccctaaggcaacagacacctccttcaagaacaagctgtatgaccagcacctgggcaagtctgccaacttccagaagcccaaggtggtcaaaggcaaggccgaggcccacttcgctctgattcactatgctggtgttgtggactacaacattactggctggctggagaagaacaaggaccccctgaatgagaccgtggttggactgtaccagaagtctgcaatgaaaactctagctcagctcttctctggggctcaaactgctgaaggagagggagctggtggaggggccaagaaaggtggtaagaagaagggctcttctttccagacagtgtctgcccttttcagagaggaacaatccaacaccaatctagctaaattccgcaagctccagcatgagctggaggaggccgaggaacgggctgacattgctgagtcccaggtgaacaaactgcgggtgaagagccgggaggttcacacaaaagtcataagtgaagagtgatcatgtcctgatgccatggaatgactgaagacaggcacaaaatgtgacatctttggtcatttccctctgtaattattgtgtattctaccctgttgcaaaggaaataaagcatagggtagtttgc

SEQ ID NO: 156980 - DNA, 6037 bp, Homo sapiens
  Payload ID: 10763
  Gene Symbol: MYH3
  Gene Name: myosin, heavy chain 3, skeletal muscle, embryonic
  Uniprot ID: P11055
  ENST ID: ENST00000583535
  CDS Start-End: 89-5911
gtggctcgcttgtgggcggaggtctgggatctcctggctgttgctgtcttctgctctcatcctgcaggtgggactctcagctgacaccatgagtagtgacactgaaatggaagtgttcggcatagctgctcctttcctccggaagtcagaaaaggagaggatcgaggctcagaaccagccctttgatgccaagacgtattgcttcgtggtggactcaaaggaagaatatgccaaggggaaaatcaagagttctcaggatgggaaggtcactgtggaaactgaggacaacaggaccctggtggtcaaaccagaggatgtgtacgccatgaacccccccaagttcgacaggatcgaagacatggccatgctgacgcacctgaatgagccagccgtgctgtacaacctgaaggaccgttacacatcttggatgatctatacctactcaggcctcttctgtgtcactgtcaacccctacaagtggctgccggtgtacaaccccgaggtggtggaaggctaccgaggcaaaaagcgccaggaggccccaccccacatcttctccatctctgacaacgcctatcagttcatgctgactgatcgtgaaaaccagtccattctgatcaccggagaatccggggcaggaaagactgtgaacaccaaacgggtcatccagtactttgcaacaattgcagctactggggacctggccaagaagaaggactccaaaatgaaggggactctggaagatcaaatcatcagtgccaatcccctgctggaggcctttgggaacgccaagactgtgaggaatgacaactcctcccgttttggcaagttcatccgaatccattttggaaccactgggaagctggcctctgcagatattgaaacttatcttctggaaaaatcaagagtcactttccagctgaaggctgaaagaagctaccacatcttctaccagattctttctaacaagaagcctgagctcatagagctgctgcttattacgaccaacccttacgactacccgttcattagccagggggagatcctggtggccagcatagatgatgcagaggagctgctggctacagacagcgccattgacatcctgggcttcaccccagaagagaaatctgggctctacaagctgacgggagccgtgatgcactacgggaacatgaagttcaagcagaagcagcgagaggagcaggccgagccggatggcacagaagtggctgacaaaacagcctatctgatgggcctgaactcttcggacctcctaaaagctttgtgctttcctagagtgaaagttgggaatgagtacgttaccaaaggtcaaactgtggatcaggttcaccatgctgtgaatgctctttcaaaatcagtttatgaaaagttgttcttgtggatggtcactcgcattaaccagcaactggatacgaagcttccaagacaacacttcattggtgttttggacattgcaggctttgaaatctttgagtataacagcctggagcagctgtgcatcaacttcaccaatgagaaactgcaacagtttttcaaccaccacatgttcgtgctggagcaggaggagtacaagaaggaaggcatcgagtggacgttcattgacttcgggatggacctggctgcctgcatcgagctcatcgagaagcctatgggcatcttctccatcctggaagaggagtgcatgttccccaaggcaacagacacctccttcaagaacaagctgtatgaccagcatcttggaaagtccaacaacttccagaagcccaaggtggtcaaaggcagggccgaggctcacttctcactgatccactatgcgggcaccgtggactacagtgtctcaggttggctggagaagaacaaggaccctctgaacgagactgtggttgggctgtaccagaagtcttccaacaggctcctggcacacctctatgccacgtttgccacggcggatgctgacagtggaaagaagaaagttgccaagaagaagggttcttccttccaaactgtctctgcccttttcagggaaaacctgaacaagctgatgtcaaatttaagaactactcaccctcattttgtgcgttgtataattcccaatgaaaccaaaactccaggggctatggaacacagccttgttctgcaccagctgcggtgtaacggtgtcctggagggcatccgcatctgcaggaaagggttcccaaacaggattctctatggcgattttaaacaaagataccgagtgctgaatgccagtgcaatccctgagggacaattcattgacagcaagaaagcctgtgaaaagcttctggcatccattgatattgaccacactcagtacaaatttggacataccaaggtgttcttcaaggctggcttgctgggaaccctggaagagatgcgggatgaccgcctggccaaactaatcacccggacacaagctgtgtgcagagggttcctcatgcgtgtggaattccagaagatggtgcagaggagggagtccatcttctgcatccagtacaacattcgctcattcatgaacgtcaagcactggccctggatgaaactcttcttcaagatcaagcccctcctcaagagtgcagagactgagaaagagatggccaccatgaaggaagaattccagaaaaccaaagatgaactcgccaagtcggaggcaaaaaggaaggagctagaggaaaaactggtgactctggtccaagagaagaatgacctgcagctccaagtacaagctgaaagcgaaaatttgttggatgctgaggaaagatgcgatcagctgatcaaagccaaattccagctcgaggccaagatcaaggaggtgacagagagagctgaagatgaggaggagatcaatgctgagctgacggccaagaagaggaaactggaggatgaatgctcagagctcaagaaagacattgatgaccttgagttgaccctggccaaggttgagaaggagaagcatgccacagagaacaaggttaaaaaccttactgaggaactctctgggttagatgaaacaattgcaaagttaaccagagagaagaaggccctccaagaggcgcaccagcaggccttggatgacctccaagctgaagaagacaaagtcaattctttgaacaaaaccaagagcaaactggaacagcaagtggaagacctggaaagctccctagaacaagaaaagaagctccgagtagacctggaaaggaacaaaaggaaattggaaggagacttgaagcttgctcaagagtccatattagatctggagaatgacaagcaacagctggacgaaaggctcaagaagaaagattttgaatattgtcaacttcaaagcaaagtggaagatgagcagacactgggcctccagtttcagaagaaaatcaaagagttgcaggctcgaattgaggagctggaagaggagatagaggcggagagggccacccgcgcgaagacagagaaacagcgcagcgactatgcccgggagctggaggagctgagcgagcggctggaggaggcgggaggcgtcacctccacgcagatagagctcaacaagaagcgggaggcggagttcctgaagctgcgcagggacctggaggaggccacactgcagcacgaagccatggtggccgcgctgaggaagaagcatgcggatagtgtggccgagcttggggagcagattgacaacctgcagcgggtcaagcagaagctggagaaggagaagagcgagttcaagctggagatcgatgacctctccagcagcatggagagtgtgtcgaaatctaaggcaaatctggaaaaaatctgccgaaccctggaggatcagttaagtgaggccaggggcaagaatgaggaaattcagaggagcctgagcgagctgaccacacagaagtctcgtttgcagaccgaggctggtgagctgagtcgtcagctggaagaaaaagaaagcatagtatcccaactttccaggagcaagcaagcctttacccagcaaacagaagagctcaagaggcagctggaggaagagaacaaggccaagaacgccctggcgcacgccctgcagtcctcccgccacgactgtgacctgctgcgggaacagtatgaggaggagcaggaaggcaaagctgagctgcagagggcgctgtccaaggccaatagtgaggttgcccagtggagaaccaaatacgagacggacgccatccagcgcacagaagagctggaggaggccaagaaaaaacttgctcagcgccttcaagattccgaggaacaggttgaggcagtgaatgctaaatgtgcttcactggagaagaccaagcagaggctgcaaggagaggtggaggatctgatggttgatgttgaaagagccaattccttggccgccgctctggacaagaagcagaggaactttgacaaggtgttggcagagtggaagacaaagtgtgaggagagccaagcagagctggaggcatccctgaaggagtcccgctccttgagcactgagctcttcaaactgaaaaatgcctacgaggaagccttagatcaacttgaaactgtgaaacgggaaaataagaacttagagcaggagatagcagatctcacagaacaaattgctgaaaatggcaaaaccatccatgaactggagaaatcaagaaagcagattgagctggaaaaggctgatatccagctggctctcgaggaagcagaggctgctcttgagcatgaagaagccaagatcctccgaatccagcttgaattgacacaagtgaaatcagaaattgatagaaagatcgccgagaaggatgaagagatcgagcagctgaagaggaactaccagagaacagtggaaaccatgcagagcgccctggacgccgaggtgcggagcaggaatgaagccatccggctcaagaagaagatggagggggacctgaatgaaatcgagatccagctgagccacgccaaccgccaggcggcggagaccctcaaacacctcaggagtgtccagggacagctgaaggatacgcagctccacctggatgatgccctccggggccaggaggacctgaaggagcagctggcgattgtggagcgcagagccaacctgctgcaggccgaggtggaggagctgcgggctactctggagcagacggagagggcccggaaactggcggaacaggagctcctggactccaacgagagggtgcagctgctgcatacccagaacaccagcctcatccacaccaagaagaagctggagacagacctcatgcagctccagagtgaggtagaagatgccagcagggatgcaaggaacgctgaggagaaggccaagaaggccatcacggacgctgccatgatggcggaggagctgaagaaggagcaggacaccagcgcccaccttgagcggatgaagaagaacctggaacagacggtgaaggacctgcagcatcgtctagatgaggccgagcagctggcgctgaagggcgggaagaagcagatccagaaactggagaccaggatccgagagctggagtttgaacttgagggagagcagaagaagaacacagagtctgttaagggcctgaggaagtatgagcggagggtcaaggagctgacgtaccagagtgaagaggacaggaagaatgtgctgagattgcaggatctggtggataaactgcaagtgaaagtcaagtcctacaagaggcaggcggaggaggctgatgaacaagccaatgctcatctcaccaaattccgaaaggctcagcatgagctggaggaggccgaggaacgtgcggatatcgcagaatctcaagtcaacaagctccgcgctaagactcgagacttcacctccagcaggatggtggtccacgagagtgaagagtgagccagcccttctggagcaggacagaagatatgcaaaatgtatattttcttgattcctgaccattgatacttaatgtccatgtgactctttttcacatgcaataaactttgctttgtttcaatctgg

SEQ ID NO: 156981 - DNA, 6016 bp, Homo sapiens
  Payload ID: 10764
  Gene Symbol: MYH4
  Gene Name: myosin, heavy chain 4, skeletal muscle
  Uniprot ID: Q9Y623
  ENST ID: ENST00000255381
  CDS Start-End: 112-5931
atccttcctcaaaattcttgaagtagttgtctgctttgagcctgccaccttcttcatctgataatacaagaggtatacctagtccagtactgccatcaataacctgcagccatgagttctgactctgagatggccatttttggggaggctgctcctttcctccgaaagtctgaaaaggagcgaattgaagctcagaacaagccttttgatgccaagacatcagtctttgtggtggaccctaaggagtcctacgtgaaagcaatagtgcagagcagggaaggggggaaggtgacagccaagaccgaagctggagctactgtaactgtgaaagaagaccaagtcttctccatgaaccctcccaaatatgacaagatcgaggacatggccatgatgactcacctgcatgagcctgctgtgctgtataacctcaaagagcgttacgcagcctggatgatctacacctactcgggcctcttctgtgtcaccgtcaacccctacaagtggctgccggtgtacaaccctgaggtggtgacagcctaccgaggcaaaaagcgccaggaggccccaccccatatcttctccatctctgacaatgcctatcagttcatgctaactgatcgtgaaaaccagtcaatcttgattactggagaatctggtgcagggaagactgtgaacacgaagcgtgtcatccagtactttgcaacaattgcagttactggagagaagaaaaaagaggaacctgcctctggcaaaatgcaggggacccttgaagatcaaatcatcagtgctaaccccctactggaagccttcggcaatgccaagaccgtgaggaatgacaactcctctcgctttggtaaattcatcaggatccattttggtgccacaggcaaactggcttctgcagatattgaaacatatctgctagagaagtcccgagttacttttcagctaaaggctgaaagaagctaccacatattttatcaaatcctgtccaataagaaaccagagctcattgaaatgcttctgatcaccaccaacccatatgacttcgcatttgtcagccaaggggaaattactgtgcccagcattgatgaccaggaagagctgatggccacagatagtgctgtggacatcctgggtttcactgctgatgaaaaggtggccatttacaagctcactggagccgtgatgcattatgggaacatgaaattcaagcaaaagcaaagggaagagcaggcagagccagatggcacggaagttgctgacaaagctgcttatctgacaagtctgaactctgctgacctgctcaaatctctctgctatcccagagtcaaggtcggcaatgagttcgtaaccaaaggccagactgtgcagcaggtgtacaatgcagtgggtgctctggccaaagccatctacgagaagatgttcctgtggatggtcacccgcatcaaccagcagctggacaccaagcagcccaggcagtacttcatcggggtcttggacattgctggctttgagatctttgatttcaacagcctggagcagctgtgcatcaacttcaccaacgagaaactgcaacagtttttcaaccaccacatgttcgtgctggagcaggaagagtacaagaaggaaggcatcgagtgggagttcattgacttcgggatggacctggctgcctgcatcgagctcatcgagaagcctatgggcatcttctccatcctagaagaggagtgcatgttccccaaggcaacagacacctccttcaagaacaagctgtatgaacaacatcttggaaaatccaacaacttccagaagcccaagcctgccaaaggcaagcctgaggctcacttctcactggtgcactatgccggcaccgtggactacaacatcgccggctggctggacaaaaacaaggaccccctgaatgagactgtggtggggctgtaccagaagtctgcaatgaagactctggctttcctcttctctggggcacaaactgctgaagcagagggtggtggtggaaagaaaggtggcaaaaagaagggttcttctttccagacagtgtcagctcttttcagggagaatttgaataagctgatgaccaacttgaggagcactcacccccactttgtgcggtgcatcatccccaatgaaactaaaactcctggtgccatggagcatgagcttgtcctgcatcagctgaggtgtaacggtgtgctggaaggcatccgcatctgcaggaaaggcttcccaagcagaatcctttatgcagacttcaaacagagatacaaggttctaaatgcgagtgctatcccagagggtcagttcattgacagcaagaaggcttctgagaaacttctagggtctattgaaattgaccacacccagtacaaattcggtcataccaaggttttcttcaaagctggcctgctgggaactctagaggaaatgcgagatgaaaagctagctcaactcatcacgcgcactcaagccatatgcagagggttcctgatgagagtggagttcagaaagatgatggagaggagagagtccatcttctgcattcagtacaacatccgtgctttcatgaatgtgaagcactggccctggatgaagctgtatttcaagatcaagcccctcctcaagagtgcagagacagagaaggagatggccaacatgaaggaagaatttgagaaaaccaaagaagagctggctaagacagaggcaaaaaggaaagaactagaagaaaagatggtgacgctaatgcaagagaaaaatgacttacaactccaagttcaagctgaagcagatgccttggctgatgcagaggaaagatgtgatcagttgattaaaaccaaaatccaacttgaggccaaaatcaaagaggtaactgaaagagctgaggatgaggaagagatcaatgctgagctgacagccaagaagaggaaactggaggatgaatgttcagagctcaagaaagacattgatgaccttgagctgacactggccaaggttgagaaggagaaacatgccacagagaacaaggtgaaaaacctcacagaagagatggcaggtctggatgaaaccattgctaagctgaccaaggagaagaaggctctccaggaggcccaccagcagaccctggatgacctgcagatggaggaggacaaagtcaacaccctgaccaaagctaaaaccaagctagaacagcaagtggacgatcttgaaggatctctggaacaagaaaagaaactttgcatggacttagaaagagccaagagaaaactggagggtgacctaaaattggcccaagaatccacaatggatacagaaaatgacaaacagcaacttaatgagaaactcaaaaagaaagagtttgaaatgagcaatctgcaaggcaagattgaagatgaacaagcccttgcaatacagctacaaaagaagatcaaagaattacaggcccgcattgaggagctggaggaggaaatcgaggcagagcgggcctcccgggccaaagcagagaagcagcgctctgacctctcccgggagctggaggagatcagtgagaggctggaagaagccggtggggccacttcagcccagattgagatgaacaagaagcgggaggctgagttccagaaaatgcgcagggacctggaagagtccaccctgcagcacgaagccacggcagctgctcttcggaagaagcacgcagatagtgtggctgagcttggggagcagattgacagccttcagcgggtcaagcagaagctggagaaggaaaagagtgagctgaagatggagatcaatgaccttgctagtaacatggagactgtctccaaagccaaggcaaactttgagaaaatgtgccgcaccctagaggaccagcttagtgaaataaaaacaaaggaagaagagcaacaacgcttaataaatgagttgtcagcccagaaggcacgtttacacacagaatcaggtgagttttcacgacagctagatgaaaaagatgctatggtttctcagctatcccgaggcaaacaagcatttacacaacagattgaagaattaaagaggcagctagaagaggagactaaggccaagagcactctggcccatgccctgcagtcagcccgccatgactgtgacctgctgcgggaacagtatgaggaggagcaggaagccaaggctgagctgcagaggggaatgtccaaggccaacagtgaggttgcccagtggaggaccaagtacgagacggacgccatccagcgcacagaggagctggaggaggccaagaagaagctagcccagcgtctgcaggatgcagaagaacatgtagaagctgtgaattccaaatgtgcttctcttgaaaagacaaagcagaggctacagaatgaagtagaggacctcatgattgatgtggaacgatctaatgctgcctgcatagctctcgataagaagcaaagaaactttgacaaggttctggcagaatggaaacagaagtatgaggaaactcaggctgaacttgaggcctcccagaaggagtcgcgttctctcagcactgagctgttcaaggtgaagaatgcctacgaggaatccctggatcatcttgaaactctaaagcgagagaataagaacttacaacaggagatttctgacctgacagagcaaattgcagagggtggaaagcatatccatgaactggagaaagtaaagaaacaacttgatcatgagaagagtgaactacagacttccctagaggaagcagaggcatctcttgagcatgaagaaggcaaaattcttcgcattcaacttgagctaaatcaggtgaaatctgagattgaccgaaaaattgctgaaaaagatgaagaactcgatcagctaaagaggaaccatctcagagttgtggagtcaatgcagagtacactggatgctgagatcaggagcagaaatgatgctctgaggatcaagaagaagatggagggagatcttaatgaaatggaaatccagctgaaccatgccaaccgccaggctgctgaggcactaaggaatcttagaaacacacaaggaatactgaaggacactcagctacatttggatgatgccatcagaggccaagatgaccttaaggaacaactggcaatggttgagcgcagagctaacctgatgcaggctgaagttgaagagctcagggcatccctggaacggactgagagaggcaggaaaatggcagagcaagagcttctggatgccagtgaacgtgtgcaacttctgcacactcagaacaccagcctgatcaacaccaagaagaagctggaaacagacatttcccaaatccagggagagatggaggacatcgtccaggaagcccgcaatgcagaggagaaggccaagaaggccatcactgatgctgccatgatggctgaggagctgaagaaggaacaggacaccagcgcccacctggagcggatgaagaagaacatggagcagaccgtgaaggatctgcagctccgtctggatgaggctgagcagctggcgctgaagggtgggaagaagcagatccagaaactggaggccagggtgagagagcttgaaagtgaggtggaaagtgaacagaagcacaatgttgaggctgtcaagggtcttcgcaaacatgagagaagagtgaaggaactcacttaccagactgaggaggaccgcaagaatattctcaggctgcaggacttggtggacaaattgcaaaccaaagtcaaagcttacaagagacaagctgaagaggctgaggaacaatccaatgtcaaccttgccaagttccgcaagctccagcacgagctggaggaggccaaggaacgggctgacattgctgagtcccaagtcaacaagctgagagtgaagagtcgggaggttcacacaaaagtcataagtgaagagtaattcattctaatgaaagaaaatgtgaccaaagaaatgcacgaaatgtgaagttctttgtcactgtcctgtatatcaaggaaataaa

SEQ ID NO: 156982 - DNA, 5871 bp, Homo sapiens
  Payload ID: 10765
  Gene Symbol: MYH6
  Gene Name: myosin, heavy chain 6, cardiac muscle, alpha
  Uniprot ID: P13533
  ENST ID: ENST00000356287
  CDS Start-End: 31-5850
cgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaggtggtggccgcctaccggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggtgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggctgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcact

SEQ ID NO: 156983 - DNA, 5941 bp, Homo sapiens
  Payload ID: 10765
  Gene Symbol: MYH6
  Gene Name: myosin, heavy chain 6, cardiac muscle, alpha
  Uniprot ID: P13533
  ENST ID: ENST00000405093
  CDS Start-End: 72-5891
agatagagagactcctgcggcccagattcttcaggattctccgtgaagggataaccaggggaagcaccaagatgaccgatgcccagatggctgactttggggcagcggcccagtacctccgcaagtcagagaaggagcgtctagaggcccagacccggccctttgacattcgcactgagtgcttcgtgcccgatgacaaggaagagtttgtcaaagccaagattttgtcccgggagggaggcaaggtcattgctgaaaccgagaatgggaagacggtgactgtgaaggaggaccaggtgttgcagcagaacccacccaagttcgacaagattgaggacatggccatgctgaccttcctgcacgagcccgcggtgcttttcaacctcaaggagcgctacgcggcctggatgatatatacctactcgggcctcttctgtgtcactgtcaacccctacaagtggctgccggtgtacaatgccgaggtggtggccgcctaccggggcaagaagaggagtgaggccccgccccacatcttctccatctccgacaacgcctatcagtacatgctgacagatcgggagaaccagtccatcctcatcacgggagaatccggggcggggaagactgtgaacaccaagcgtgtcatccagtactttgccagcattgcagccataggtgaccgtggcaagaaggacaatgccaatgcgaacaagggcaccctggaggaccagatcatccaggccaaccccgctctggaggccttcggcaatgccaagactgtccggaacgacaactcctcccgctttgggaaattcattaggatccactttggggccactggaaagctggcttctgcagacatagagacctacctgctggagaagtcccgggtgatcttccagctgaaagctgagagaaactaccacatcttctaccagattctgtccaacaagaagccggagttgctggacatgctgctggtcaccaacaatccctacgactacgccttcgtgtctcagggagaggtgtccgtggcctccattgatgactccgaggagctcatggccaccgatagtgcctttgacgtgctgggcttcacttcagaggagaaagctggcgtctacaagctgacgggagccatcatgcactacgggaacatgaagttcaagcagaagcagcgggaggagcaggcggagccagacggcaccgaagatgctgacaagtcggcctacctcatggggctgaactcagctgacctgctcaaggggctgtgccaccctcgggtgaaagtgggcaacgagtatgtcaccaaggggcagagcgtgcagcaggtgtactactccatcggggctctggccaaggcagtgtatgagaagatgttcaactggatggtgacgcgcatcaacgccaccctggagaccaagcagccacgccagtacttcataggagtcctggacatcgctggcttcgagatcttcgacttcaacagctttgagcagctctgcatcaacttcaccaacgagaagctgcagcagttcttcaaccaccacatgttcgtgctggagcaggaggagtacaagaaggagggcattgagtggacattcattgactttggcatggacctgcaggcctgcattgacctcatcgagaagcccatgggcatcatgtccatcctggaggaggagtgcatgttccccaaggccactgacatgaccttcaaggccaagctgtacgacaaccacctgggcaagtccaacaatttccagaagccacgcaacatcaaggggaagcaggaagcccacttctccctgatccactacgccggcactgtggactacaacatcctgggctggctggaaaaaaacaaggatcctctcaacgagactgttgtggccctgtaccagaagtcctccctcaagctcatggccactctcttctcctcctacgcaactgccgatactggggacagtggtaaaagcaaaggaggcaagaaaaagggctcatccttccagacggtgtcggctctccaccgggaaaatctcaacaagctaatgaccaacctgaggaccacccatcctcactttgtgcgttgcatcatccccaatgagcggaaggctccaggggtgatggacaaccccctggtcatgcaccagctgcgctgcaatggcgtgctggagggcatccgcatctgcaggaagggcttccccaaccgcatcctctacggggacttccggcagaggtatcgcatcctgaacccagtggccatccctgagggacagttcattgatagcaggaaggggacagagaagctgctcagctctctggacattgatcacaaccagtacaagtttggccacaccaaggtgttcttcaaggcagggctgcttgggctgctggaggagatgcgggatgagaggctgagccgcatcatcacgcgcatgcaggcccaagcccggggccagctcatgcgcattgagttcaagaagatagtggaacgcagggatgccctgctggtaatccagtggaacattcgggccttcatgggggtcaagaattggccctggatgaagctctacttcaagatcaagccgctgctgaagagcgcagagacggagaaggagatggccaccatgaaggaagagttcgggcgcatcaaagagacgctggagaagtccgaggctcgccgcaaggagctggaggagaagatggtgtccctgctgcaggagaagaatgacctgcagctccaagtgcaggcggaacaagacaacctcaatgatgctgaggagcgctgcgaccagctgatcaaaaacaagattcagctggaggccaaagtaaaggagatgaatgagaggctggaggatgaggaggagatgaacgcggagctcactgccaagaagcgcaagctggaagacgagtgctcagagctcaagaaggacattgatgacctggagctgacactggccaaggtggagaaggagaagcatgcaacagagaacaaggtgaagaacctaacagaggagatggctgggctggatgaaatcatcgctaagctgaccaaggagaagaaagctctacaagaggcccatcagcaggccctggatgaccttcaggttgaggaagacaaggtcaacagcctgtccaagtctaaggtcaagctggagcagcaggtggatgatctggagggatccctagagcaagagaagaaggtgcgcatggacctggagcgagcaaagcggaaactggagggcgacctgaagctgacccaggagagcatcatggacctggaaaatgataaactgcagctggaagaaaagcttaagaagaaggagtttgacattaatcagcagaacagtaagattgaggatgagcaggtgctggcccttcaactacagaagaaactgaaggaaaaccaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggcaaacctggagaaagtgtctcggacgctggaggaccaggccaatgagtaccgcgtgaagctagaagaggcccaacgctccctcaatgatttcaccacccagcgagccaagctgcagaccgagaatggagagttggcccggcagctagaggaaaaggaggcgctaatctcgcagctgacccgggggaagctctcttatacccagcaaatggaggacctcaaaaggcagctggaggaggagggcaaggcgaagaacgccctggcccatgcactgcagtcggcccggcatgactgcgacctgctgcgggagcagtacgaggaggagacagaggccaaggccgagctgcagcgcgtcctgtccaaggccaactcggaggtggcccagtggaggaccaagtatgagacggacgccattcagcggactgaggagctcgaagaggccaaaaagaagctggcccagcggctgcaggatgccgaggaggccgtggaggctgttaatgccaagtgctcctcactggagaagaccaagcaccggctacagaatgagatagaggacttgatggtggacgtagagcgctccaatgctgctgctgcagccctggacaagaagcagagaaactttgacaagatcctggccgagtggaagcagaagtatgaggagtcgcagtctgagctggagtcctcacagaaggaggctcgctccctcagcacagagctcttcaagctcaagaacgcctacgaggagtccctggagcacctagagaccttcaagcgggagaacaagaaccttcaggaggaaatctcggaccttactgagcagctaggagaaggaggaaagaatgtgcatgagctggagaaggtccgcaaacagctggaggtggagaagctggagctgcagtcagccctggaggaggcagaggcctccctggagcacgaggagggcaagatcctccgggcccagctagagttcaaccagatcaaggcagagatcgagcggaagctggcagagaaggacgaggagatggaacaggccaagcgcaaccaccagcgggtggtggactcgctgcagacctccctggatgcagagacacgcagccgcaacgaggtcctgagggtgaagaagaagatggaaggagacctcaatgagatggagatccagctcagccacgccaaccgcatggctgccgaggcccagaagcaagtcaagagcctccagagcttgctgaaggacacccagatccagctggacgatgcggtccgtgccaacgacgacctgaaggagaacatcgccatcgtggagcggcgcaacaacctgctgcaggctgagctggaggagctgcgtgccgtggtggagcagacagagcggtcccggaagctggcggagcaggagctgattgagaccagcgagcgggtgcagctgctgcattcccagaacaccagcctcatcaaccagaagaagaagatggagtcggatctgacccagctccagtcggaagtggaggaggcagtgcaggagtgcagaaacgccgaggagaaggccaagaaggccatcacggatgccgccatgatggcagaggagctgaagaaggagcaggacaccagcgcccacctggagcgcatgaagaagaacatggagcagaccattaaggacctgcagcaccggctggacgaggccgagcagatcgccctcaagggaggcaagaagcagctgcagaagctggaagcgcgggtgcgggagctggagggtgagctggaggccgagcagaagcgcaacgcagagtcggtgaagggcatgaggaagagcgagcggcgcatcaaggagctcacctaccagacagaggaagacaaaaagaacctgctgcggctacaggacctggtggacaagctgcaactgaaggtcaaggcctacaagcgccaggccgaggaggcggaggagcaagccaacaccaacctgtccaagttccgcaaggtgcagcatgagctggatgaggcagaggagcgggcggacatcgctgagtcccaggtcaacaagcttcgagccaagagccgtgacattggtgccaagcaaaaaatgcacgatgaggagtgacactgcctcgggaacctcactcttgccaacctgtaataaatatgagtgcc

SEQ ID NO: 156984 - DNA, 6087 bp, Homo sapiens
  Payload ID: 10766
  Gene Symbol: MYH7
  Gene Name: myosin, heavy chain 7, cardiac muscle, beta
  Uniprot ID: P12883
  ENST ID: ENST00000355349
  CDS Start-End: 164-5971
gggggtgggggtgccctgctgccccatatatacagcccctgagaccaggtctggctccacagctctgtcctgctctgtgtctttccctgctgctctcaggtcccctgcaggccttggcccctttcctcatctgtagacacacttgagtagcccaggcacagccatgggagattcggagatggcagtctttggggctgccgccccctacctgcgcaagtcagagaaggagcggctagaagcgcagaccaggccttttgacctcaagaaggatgtcttcgtgcctgatgacaaacaggagtttgtcaaggccaagatcgtgtctcgagagggtggcaaagtcactgccgagaccgagtatggcaagacagtgaccgtgaaggaggaccaggtgatgcagcagaacccacccaagttcgacaaaatcgaggacatggccatgctgaccttcctgcatgagcccgcggtgctctacaacctcaaggatcgctacggctcctggatgatctacacctactcgggcctcttctgtgtcaccgtcaacccttacaagtggctgccggtgtacactcctgaggtggtggctgcctaccggggcaagaagaggagcgaggccccgccccacatcttctccatctccgacaacgcctatcagtacatgctgacagacagagaaaaccagtccatcctgatcaccggagaatccggagcagggaagacagtcaacaccaagagggtcatccagtactttgctgttattgcagccattggggaccgcagcaagaaggaccagagcccgggcaagggcaccctggaggaccagatcatccaggccaaccctgctctggaggcctttggcaatgccaagaccgtccggaacgacaactcctcccgcttcgggaaattcattcgaattcattttggggcaacaggaaagttggcatctgcagacatagagacctatcttctggaaaaatccagagttattttccagctgaaagcagagagagattatcacattttctaccaaatcctgtctaacaaaaagcctgagctgctggacatgctgctgatcaccaacaacccctacgattatgcattcatctcccaaggagagaccaccgtggcctccattgatgacgctgaggagctcatggccactgataacgcttttgatgtgctgggcttcacttcagaggagaaaaactccatgtataagctgacaggcgccatcatgcactttggaaacatgaagttcaagctgaagcagcgggaggagcaggcggagccagacggcactgaagaggctgacaagtctgcctacctcatggggctgaactcagccgacctgctcaaggggctgtgccaccctcgggtgaaagtgggcaatgagtacgtcaccaaggggcagaatgtccagcaggtgatatatgccactggggcactggccaaggcagtgtatgagaggatgttcaactggatggtgacgcgcatcaatgccaccctggagaccaagcagccacgccagtacttcataggagtcctggacatcgctggcttcgagatcttcgatttcaacagctttgagcagctctgcatcaacttcaccaacgagaagctgcagcagttcttcaaccaccacatgtttgtgctggagcaggaggagtacaagaaggagggcatcgagtggacattcattgactttggcatggacctgcaggcctgcattgacctcatcgagaagcccatgggcatcatgtccatcctggaagaggagtgcatgttccccaaggccaccgacatgaccttcaaggccaagctgtttgacaaccacctgggcaaatccgccaacttccagaagccacgcaatatcaaggggaagcctgaagcccacttctccctgatccactatgccggcatcgtggactacaacatcattggctggctgcagaagaacaaggatcctctcaatgagactgtcgtgggcttgtatcagaagtcttccctcaagctgctcagcaccctgtttgccaactatgctggggctgatgcgcctattgagaagggcaaaggcaaggccaagaaaggctcgtcctttcagactgtgtcagctctgcacagggaaaatctgaacaagctgatgaccaacttgcgctccacccatccccactttgtacgttgtatcatccctaatgagacaaagtctccaggggtgatggacaaccccctggtcatgcaccagctgcgctgcaatggtgtgctggagggcatccgcatctgcaggaaaggcttccccaaccgcatcctctacggggacttccggcagaggtatcgcatcctgaacccagcggccatccctgagggacagttcattgatagcaggaagggggcagagaagctgctcagctccctggacattgatcacaaccagtacaagtttggccacaccaaggtgttcttcaaggccgggctgctggggctgctggaggaaatgagggacgagaggctgagccgcatcatcacgcgtatccaggcccagtcccgaggtgtgctcgccagaatggagtacaaaaagctgctggaacgtagagactccctgctggtaatccagtggaacattcgggccttcatgggggtcaagaattggccctggatgaagctctacttcaagatcaagccgctgctgaagagtgcagaaagagagaaggagatggcctccatgaaggaggagttcacacgcctcaaagaggcgctagagaagtccgaggctcgccgcaaggagctggaggagaagatggtgtccctgctgcaggagaagaatgacctgcagctccaagtgcaggcggaacaagacaacctggcagatgctgaggagcgctgtgatcagctgatcaaaaacaagattcagctggaggccaaggtgaaggagatgaacgagaggctggaggatgaggaggagatgaatgctgagctcactgccaagaagcgcaagctggaagatgagtgctcagagctcaaaagggacatcgatgatctggagctgacactggccaaagtggagaaggagaaacacgcaacagagaacaaggtgaaaaacctgacagaggagatggctgggctggatgagatcattgccaagctgaccaaggagaagaaagctctgcaagaggcccaccaacaggctctggatgaccttcaggccgaggaggacaaggtcaacaccctgactaaggccaaagtcaagctggagcagcaagtggatgatctggaaggatccctggagcaagagaagaaggtgcgcatggacctggagcgagcgaagcggaagctggagggcgacctgaagctgacccaggagagcatcatggacctggagaatgacaagcagcagctggatgagcggctgaaaaaaaaagactttgagctgaatgctctcaacgcaaggattgaggatgaacaggccctcggcagccagctgcagaagaagctcaaggagcttcaggcacgcatcgaggagctggaggaggagctggaggccgagcgcaccgccagggctaaggtggagaagctgcgctcagacctgtctcgggagctggaggagatcagcgagcggctggaagaggccggcggggccacgtccgtgcagatcgagatgaacaagaagcgcgaggccgagttccagaagatgcggcgggacctggaggaggccacgctgcagcacgaggccactgccgcggccctgcgcaagaagcacgccgacagcgtggccgagctgggcgagcagatcgacaacctgcagcgggtgaagcagaagctggagaaggagaagagcgagttcaagctggagctggatgacgtcacctccaacatggagcagatcatcaaggccaaggctaacctggagaagatgtgccggaccttggaagaccagatgaatgagcaccggagcaaggcggaggagacccagcgttctgtcaacgacctcaccagccagcgggccaagttgcaaaccgagaatggtgagctgtcccggcagctggatgagaaggaggcactgatctcccagctgacccgaggcaagctcacctacacccagcagctggaggacctcaagaggcagctggaggaggaggttaaggcgaagaacgccctggcccacgcactgcagtcggcccggcatgactgcgacctgctgcgggagcagtacgaggaggagacggaggccaaggccgagctgcagcgcgtcctttccaaggccaactcggaggtggcccagtggaggaccaagtatgagacggacgccattcagcggactgaggagctcgaggaggccaagaagaagctggcccagcggctgcaggaagctgaggaggccgtggaggctgttaatgccaagtgctcctcgctggagaagaccaagcaccggctacagaatgagatcgaggacttgatggtggacgtagagcgctccaatgctgctgctgcagccctggacaagaagcagaggaacttcgacaagatcctggccgagtggaagcagaagtatgaggagtcgcagtcggagctggagtcctcgcagaaggaggctcgctccctcagcacagagctcttcaaactcaagaacgcctatgaggagtccctggaacatctggagaccttcaagcgggagaacaaaaacctgcaggaggagatctccgacttgactgagcagttgggttccagcggaaagactatccatgagctggagaaggtccgaaagcagctggaggccgagaagatggagctgcagtcagccctggaggaggccgaggcctccctggagcacgaggagggcaagatcctccgggcccagctggagttcaaccagatcaaggcagagatcgagcggaagctggcagagaaggacgaggagatggaacaggccaagcgcaaccacctgcgggtggtggactcgctgcagacctccctggacgcagagacacgcagccgcaacgaggccctgagggtgaagaagaagatggaaggagacctcaatgagatggagatccagctcagccacgccaaccgcatggccgccgaggcccagaagcaagtcaagagcctccagagcttgttgaaggacacccagattcagctggacgatgcagtccgtgccaacgacgacctgaaggagaacatcgccatcgtggagcggcgcaacaacctgctgcaggctgagctggaggagttgcgtgccgtggtggagcagacagagcggtcccggaagctggcggagcaggagctgattgagactagtgagcgggtgcagctgctgcattcccagaacaccagcctcatcaaccagaagaagaagatggatgctgacctgtcccagctccagactgaagtggaggaggcagtgcaggagtgcaggaatgctgaggagaaggccaagaaggccatcacggatgccgccatgatggcagaggagctgaagaaggagcaggacaccagcgcccacctggagcgcatgaagaagaacatggaacagaccattaaggacctgcagcaccggctggacgaagccgagcagatcgccctcaagggcggcaagaagcagctgcagaagctggaagcgcgggtgcgggagctggagaatgagctggaggccgagcagaagcgcaacgcagagtcggtgaagggcatgaggaagagcgagcggcgcatcaaggagctcacctaccagacggaggaggacaggaaaaacctgctgcggctgcaggacctggtagacaagctgcagctaaaggtcaaggcctacaagcgccaggccgaggaggcggaggagcaagccaacaccaacctgtccaagttccgcaaggtgcagcacgagctggatgaggcagaggagcgggcggacatcgccgagtcccaggtcaacaagctgcgggccaagagccgtgacattggcacgaagggcttgaatgaggagtagctttgccacatcttgatctgctcagccctggaggtgccagcaaagccccatgctggagcctgtgtaacagctccttgggaggaagcagaataaagcaattttccttgaagccgaga

SEQ ID NO: 156985 - DNA, 6293 bp, Homo sapiens
  Payload ID: 10767
  Gene Symbol: MYH7B
  Gene Name: myosin, heavy chain 7B, cardiac muscle, beta
  Uniprot ID: A7E2Y1
  ENST ID: ENST00000262873
  CDS Start-End: 93-6044
tggggttttgatgtgttgcccaggctggtcttgaactcctgagcttaagtgatgtgtccgcctgggcctcccaaagtgctggaattacagacatgagtggcaataaaaggggtagcagagcttcctgccctcaccgtggtgccgagtgcctgctgccttgggccgccttgaacctccagggtttccagctcctcctccttcaccccagtgccactgccatgatggatgtgagtgaacttggggagtctgcccgctacctccgccagggctaccaggagatgacgaaggtgcacactatcccatgggacgggaagaagcgagtctgggtgcctgatgaacaggacgcctacgtggaggccgaggtcaagtcggaggctaccgggggcagagtcaccgtggagaccaaagaccagaaggtgctgatggtgcgtgaagccgagctgcagcccatgaacccgcctcgcttcgacttactggaggacatggccatgatgacgcacctgaacgaggcctctgtgctgcacaacctgcgccagcgctatgcccgctggatgatctatacctactcaggcctcttctgtgtcaccatcaacccctacaaatggctcccagtctatacggcctccgtagtggctgcttacaagggaaagcgccgctcagattccccgccccatatatatgcggtggcggacaacgcctacaacgacatgctgcgcaaccgagacaaccagtccatgctgatcaccggagagtcgggggccggtaagacggttaacaccaagcgggtcattcagtactttgccatcgtcgctgccctgggagacgggccgggcaagaaggcccaatttctggcaacaaagacggggggcacccttgaggatcaaatcatcgaggccaaccctgccatggaggcctttggcaacgccaagaccctgaggaatgataactcctcccgctttggcaagttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgaccaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 156986 - DNA, 699 bp, Homo sapiens
  Payload ID: 10767
  Gene Symbol: MYH7B
  Gene Name: myosin, heavy chain 7B, cardiac muscle, beta
  ENST ID: ENST00000435272
  CDS Start-End: 1-450
gtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 156987 - DNA, 684 bp, Homo sapiens
  Payload ID: 10767
  Gene Symbol: MYH7B
  Gene Name: myosin, heavy chain 7B, cardiac muscle, beta
  ENST ID: ENST00000446156
  CDS Start-End: 1-435
gtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggtgagtgcgctggggcctggacacctggaccgggcaccccagctctgccccagggtctgtggccaggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 156988 - DNA, 691 bp, Homo sapiens
  Payload ID: 10767
  Gene Symbol: MYH7B
  Gene Name: myosin, heavy chain 7B, cardiac muscle, beta
  ENST ID: ENST00000456649
  CDS Start-End: 1-450
gtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaaggtgaggagtggcaggggcattgctctctgtgcagggggactgtgggggctgacaggtagtactgctcactcagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 156989 - DNA, 618 bp, Homo sapiens
  Payload ID: 10767
  Gene Symbol: MYH7B
  Gene Name: myosin, heavy chain 7B, cardiac muscle, beta
  ENST ID: ENST00000453028
  CDS Start-End: 1-369
gtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 156990 - DNA, 681 bp, Homo sapiens
  Payload ID: 10767
  Gene Symbol: MYH7B
  Gene Name: myosin, heavy chain 7B, cardiac muscle, beta
  ENST ID: ENST00000433934
  CDS Start-End: 1-432
gtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 156991 - DNA, 6197 bp, Homo sapiens
  Payload ID: 10767
  Gene Symbol: MYH7B
  Gene Name: myosin, heavy chain 7B, cardiac muscle, beta
  ENST ID: ENST00000618182
  CDS Start-End: 1-5949
agtggcaataaaaggggtagcagagcttcctgccctcaccgtggtgccgagtgcctgctgccttgggccgccttgaacctccagggtttccagctcctcctccttcaccccagtgccactgccatgatggatgtgagtgaacttggggagtctgcccgctacctccgccagggctaccaggagatgacgaaggtgcacactatcccatgggacgggaagaagcgagtctgggtgcctgatgaacaggacgcctacgtggaggccgaggtcaagtcggaggctaccgggggcagagtcaccgtggagaccaaagaccagaaggtgctgatggtgcgtgaagccgagctgcagcccatgaacccgcctcgcttcgacttactggaggacatggccatgatgacgcacctgaacgaggcctctgtgctgcacaacctgcgccagcgctatgcccgctggatgatctatacctactcaggcctcttctgtgtcaccatcaacccctacaaatggctcccagtctatacggcctccgtagtggctgcttacaagggaaagcgccgctcagattccccgccccatatatatgcggtggcggacaacgcctacaacgacatgctgcgcaaccgagacaaccagtccatgctgatcaccggagagtcgggggccggtaagacggttaacaccaagcgggtcattcagtactttgccatcgtcgctgccctgggagacgggccgggcaagaaggcccaatttctggcaacaaagacggggggcacccttgaggatcaaatcatcgaggccaaccctgccatggaggcctttggcaacgccaagaccctgaggaatgataactcctcccgctttggcaagttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgaccaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcc

SEQ ID NO: 156992 - DNA, 6041 bp, Homo sapiens
  Payload ID: 10768
  Gene Symbol: MYH8
  Gene Name: myosin, heavy chain 8, skeletal muscle, perinatal
  Uniprot ID: P13535
  ENST ID: ENST00000403437
  CDS Start-End: 96-5909
atttccaccaagaacccagagagtggaacacttctgaacctgcatttttatctggaactccagaggcagaatcctttgctaaataaatcgcagccatgagtgcgagctcagacgctgagatggctgtttttggcgaagctgctccctaccttcgaaaatcagaaaaggagcggattgaggcccaaaacaagccgtttgatgctaaaacatctgtctttgtggcggagcccaaggaatcctatgtgaagagcactatacaaagcaaagaaggagggaaagtaaccgtaaagactgaaggtggagcaactctaactgtcagggaagaccaagtcttccctatgaaccctccgaaatatgacaaaattgaggacatggccatgatgactcatctacacgagcctggagtgctgtacaacctcaaagagcgctatgcagcctggatgatctacacctactcaggcctcttctgtgtcaccgtcaacccctacaagtggctgccggtgtacaagcccgaggtggtggctgcctacagaggcaaaaagcgccaggaggccccgccccacatcttctccatctctgacaatgcctatcagttcatgttgactgatcgagagaatcagtccatcctgatcaccggagaatctggtgccggaaagactgtgaacaccaagcgtgtcatccaatactttgcaacaattgcagttactggagagaagaagaaggatgaatctggcaaaatgcaggggactctggaagatcaaatcatcagcgccaatcccctactggaggcctttggcaatgccaaaactgtgaggaatgacaactcctctcgctttggtaaattcattagaatccactttggtactacagggaagctggcatctgctgatatagaaacatatcttttagaaaagtccagagttactttccagctaaaggcggaaagaagctaccatattttttatcagatcacttccaataagaagccagatctaattgaaatgctcctgatcaccaccaacccatatgactatgccttcgtcagtcagggggagatcacagttcccagtattgatgaccaagaagagttgatggccactgatagtgccattgacatcctgggcttcactcctgaagagaaagtgtccatctataaactcacaggggctgtgatgcattatgggaacatgaaattcaagcaaaagcagcgtgaggagcaagctgagccagatggcacagaagtcgctgacaaggcagcctatctccagagtctgaactctgcagacctactcaaagccctctgctaccctagggtcaaggttggcaatgagtatgtcaccaaaggccagactgtgcagcaggtgtacaatgcggtgggtgctctggccaaagccgtctacgagaagatgttcctgtggatggtcacccgcatcaaccagcagctggacaccaagcagcccaggcagtacttcatcggggtcttggacattgctggctttgaaatctttgattttaacagcctggagcagctgtgcatcaacttcaccaacgagaaactgcaacagtttttcaaccaccacatgtttgtgctagagcaggaggagtacaagaaggaaggcatcgagtggacgttcattgactttgggatggacctggctgcctgcattgagctcattgagaagccactgggcatcttctccatcctggaagaggagtgcatgttccctaaggcaacggacacctccttcaagaacaagctgtatgaccagcacctgggcaagtctgccaacttccagaagcccaaggtggtcaaaggcaaggctgaggcccacttctctctgattcactatgctggcactgtggactacaacattactggctggctggacaaaaataaggaccccctgaatgatactgtggttgggctgtaccagaagtctgcaatgaagactctagccagtctcttttccacgtatgctagtgctgaagcagatagcagcgcgaagaaaggtgctaagaaaaagggctcttctttccagactgtgtctgcccttttcagggaaaatttaaataaattgatgacgaatctgaggagcacacaccctcacttcgtacggtgtatcattcccaatgaaaccaaaactcctggggcaatggaacatgaacttgtgttgcaccagctgaggtgtaatggtgtgctggaaggcatccgcatctgtaggaaaggattcccaagcagaatcttatatggtgatttcaaacaaagatacaaggttttaaatgcaagtgctattccagagggacagttcattgacagcaagaaggcttctgagaaacttcttgcatctattgatattgatcatactcaatataaatttggacataccaaggttttcttcaaagctggacttctgggtcttctggaagaaatgagagatgaaaaattagcccaaattataacaagaacacaagctgtctgtaggggattcctaatgagggtagaatatcagaagatgttgcaaaggagagaagcacttttctgcatccagtataatgtccgtgccttcatgaacgtcaagcactggccctggatgaaactctttttcaagattaagcccctcctcaagagtgcagagaccgagaaagagatggccaccatgaaggaagaattccagaaaaccaaagatgaactcgccaagtcagaggcaaaacggaaggagctagaggaaaaaatggtcactctcttaaaagagaaaaatgacctgcaactccaggttcaatctgaagcagatagcttggctgatgcagaggaaaggtgtgagcaactgattaaaaacaaaatccaacttgaggccaaaatcaaagaggtgactgaaagagctgaggaggaggaagagatcaatgctgagctgacagccaagaagagaaaactggaggatgaatgttcagaactcaagaaagacattgatgaccttgagctgacactggccaaggttgagaaggagaaacatgccacggagaacaaggtgaaaaatcttacagaagagatggcaggcctggatgaaaccattgcaaaactgtccaaggagaagaaggctctccaagagacccaccagcagaccctggatgacctgcaggcagaggaggacaaagtcaacatcctgaccaaagctaaaaccaagctagaacagcaagtggatgatcttgaagggtctctggaacaagaaaagaagcttcgaatggatctagaaagagcaaagcggaaactggagggtgacctcaaattggcccaagaatccacaatggatatggaaaatgacaaacagcaacttgatgaaaagcttgaaaagaaagaatttgaaatcagcaatttgataagcaaaattgaagatgagcaagctgtagaaattcaactacagaagaagatcaaagagttgcaggcccgcattgaggagctgggggaagaaatcgaggcagagagggcgtcccgagccaaagcggagaagcagcgctctgacctctcccgggaactggaggagatcagcgagaggctggaagaagccggtggggcaacttctgctcaggtggaattgaacaagaagcgggaggctgagtttcagaaactgcgcagggacctggaggaggccaccctgcagcatgaagctatggtggctgctcttcggaagaagcacgcagacagtatggctgagcttggggagcagattgacaacttgcagcgggtcaaacagaagctggagaaggagaagagtgagctgaagatggagactgatgacctcagcagtaacgcagaggccatttccaaagccaagggaaaccttgaaaagatgtgccgctctctagaagatcaagtgagtgagcttaagaccaaggaagaggagcagcagcggctgatcaatgacctcacagcacagagagcgcgcctgcagacagaagcgggtgaatattctcgacaattagatgagaaagatgctttagtctctcagctttcaaggagcaagcaagcatctactcagcagattgaagagctgaaacatcaactagaggaagaaactaaagccaagaacgccctggcacacgccctgcagtcctcccgccatgactgcgacctgctgcgggaacagtatgaggaagagcaggaaggcaaagctgagctgcagagggcgctgtccaaggccaacagtgaggttgcccagtggagaaccaaatacgagacggatgccatccagcgcacagaggagctggaggaggccaagaaaaagttggcccagcgcctgcaagaagctgaggaacatgtagaagctgtgaacgccaaatgtgcttcccttgagaagacgaagcagcggctccagaatgaagttgaagacctcatgcttgatgtggaaaggtctaatgcagcctgtgcagcccttgataagaagcaaaggaactttgacaaggtcctatcagaatggaagcagaagtatgaggaaactcaggctgaacttgaggcctcccagaaggagtcacgttctcttagcactgagctgttcaaggtgaagaatgtctatgaggaatccctggatcaactcgaaacgctaagaagagaaaataagaacttgcaacaggagatttctgacctcactgagcagattgcagagggaggaaagcaaattcatgaattggagaaaataaagaagcaagtagaacaagagaaatgtgaaattcaggctgctttagaggaagcagaggcatctcttgaacatgaagaaggaaagattctgcgtatccagcttgagttaaaccaagtcaagtctgaagttgatagaaaaatcgcagaaaaggatgaggaaattgaccagctgaagagaaaccacactagagtcgtggagacaatgcagagcacgctggatgcagagattagaagcagaaatgatgctctgagagtcaagaagaaaatggaaggagatctgaatgaaatggaaatccagctgaaccatgccaatcgcttagctgcagagagtttaaggaactacaggaacacccaaggaatcctgaaggaaacccagctccacctggatgatgctctccggggccaggaggacctcaaggaacagctggcaattgtggagcgcagagccaacctgctgcaggctgagatcgaggagctgtgggccactctggaacagacagagagaagcaggaaaatcgccgaacaggagctcctggatgccagtgagcgtgtccagctcctccacacccagaataccagtctcattaacaccaagaagaaattagaaaatgacgtttcccaactccaaagtgaagtggaagaagtaatccaagaatcacgcaatgcagaagagaaagccaagaaggccatcactgatgctgccatgatggctgaggagctgaagaaggaacaggacaccagcgcccacctggagcggatgaagaagaacctggagcagacggtgaaggacctgcagcatcgtctagatgaggccgagcagctggcgctgaagggtgggaagaagcagatccagaaactggaggccagggtacgtgagcttgaaggagaggttgaaaatgaacagaaacgtaatgcagaggctgttaaaggtttacggaaacatgagcgacgagtaaaagaactcacctaccagactgaagaagatcgcaagaatgttctcaggctgcaggacttggtagataaattacaggcgaaggtgaaatcatacaagagacaagctgaggaggctgaggaacaatccaatgctaatctatctaaattccgcaaactccagcatgagctggaggaggccgaggaacgggctgacattgctgagtcccaggtcaacaaattgcgagtgaagagccgagaggttcacacaaaaatcagtgcagagtaaacacacctgcctgatgctatcaagaggctgaagaaaggcacaaaatgtgctatttttggtcacttgctttatgacgtttattttcctgttaaagctgaataaataaaaactacagtaaatgtatacattaaa

SEQ ID NO: 156993 - DNA, 7501 bp, Homo sapiens
  Payload ID: 10769
  Gene Symbol: MYH9
  Gene Name: myosin, heavy chain 9, non-muscle
  Uniprot ID: P35579
  ENST ID: ENST00000216181
  CDS Start-End: 232-6114
gagggcggggcgggaaggcggcgaggagccgagctgggtgcggtgaggcgcgcagatcaccgcggttcctgggcagggcacggaaggctaagcaaggctgacctgctgcagctcccgcctcgtgcgctcgccccacccggccgccgcccgagcgctcgagaaagtcctctcgggagaagcagcgcctgttcccggggcagatccaggttcaggtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggctctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggcccagatgaaggactgcatgcgcgagctggatgacacccgcgcctctcgtgaggagatcctggcccaggccaaagagaacgagaagaagctgaagagcatggaggccgagatgatccagttgcaggaggaactggcagccgcggagcgtgccaagcgccaggcccagcaggagcgggatgagctggctgacgagatcgccaacagcagcggcaaaggagccctggcgttagaggagaagcggcgtctggaggcccgcatcgcccagctggaggaggagctggaggaggagcagggcaacacggagctgatcaacgaccggctgaagaaggccaacctgcagatcgaccagatcaacaccgacctgaacctggagcgcagccacgcccagaagaacgagaatgctcggcagcagctggaacgccagaacaaggagcttaaggtcaagctgcaggagatggagggcactgtcaagtccaagtacaaggcctccatcaccgccctcgaggccaagattgcacagctggaggagcagctggacaacgagaccaaggagcgccaggcagcctgcaaacaggtgcgtcggaccgagaagaagctgaaggatgtgctgctgcaggtggatgacgagcggaggaacgccgagcagtacaaggaccaggccgacaaggcatctacccgcctgaagcagctcaagcggcagctggaggaggccgaagaggaggcccagcgggccaacgcctcccgccggaaactgcagcgcgagctggaggacgccactgagacggccgatgccatgaaccgcgaagtcagctccctaaagaacaagctcaggcgcggggacctgccgtttgtcgtgccccgccgaatggcccggaaaggcgccggggatggctccgacgaagaggtagatggcaaagcggatggggctgaggccaaacctgccgaataagcctcttctcctgcagcctgagatggatggacagacagacaccacagcctccccttcccagaccccgcagcacgcctctccccaccttcttgggactgctgtgaacatgcctcctcctgccctccgccccgtccccccatcccgtttccctccaggtgttgttgagggcatttggcttcctctgctgcatccccttccagctccctcccctgctcagaatctgataccaaagagacagggcccgggcccaggcagagagcgaccagcaggctcctcagccctctcttgccaaaaagcacaagatgttgaggcgagcagggcaggcccccggggaggggccagagttttctatgaatctatttttcttcagactgaggccttttggtagtcggagcccccgcagtcgtcagcctccctgacgtctgccaccagcgcccccactcctcctcctttctttgctgtttgcaatcacacgtggtgacctcacacacctctgccccttgggcctcccactcccatggctctgggcggtccagaaggagcaggccctgggcctccacctctgtgcagggcacagaaggctggggtggggggaggagtggattcctccccaccctgtcccaggcagcgccactgtccgctgtctccctcctgattctaaaatgtctcaagtgcaatgccccctcccctcctttaccgaggacagcctgcctctgccacagcaaggctgtcggggtcaagctggaaaggccagcagccttccagtggcttctcccaacactcttggggaccaaatatatttaatggttaagggacttgtcccaagtctgacagccagagcgttagaggggccagcggccctcccaggcgatcttgtgtctactctaggactgggcccgagggtggtttacctgcaccgttgactcagtatagtttaaaaatctgccacctgcacaggtatttttgaaagcaaaataaggttttcttttttcccctttcttgtaataaatgataaaattccgagtctttctcactgcctttgtttagaagagagtagctcgtcctcactggtctacactggttgccgaatttacttgtattcctaactgttttgtatatgctgcattgagacttacggcaagaaggcattttttttttttaaaggaaacaaactctcaaatcatgaagtgatataaaagctgcatatgcctacaaagctctgaattcaggtcccagttgctgtcacaaaggagtgagtgaaactcccaccctacccccttttttatataataaaagtgccttagcatgtgttgcagctgtcaccactacagtaagctggtttacagatgttttccactgagcatcacaataaagagaaccatgtgct

SEQ ID NO: 156994 - DNA, 789 bp, Homo sapiens
  Payload ID: 10769
  Gene Symbol: MYH9
  Gene Name: myosin, heavy chain 9, non-muscle
  ENST ID: ENST00000401701
  CDS Start-End: 87-743
aggggctggtgttcggggctgccccgagcccagctctgggagcttattttgtcatcacagtggcactgtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccaggaggcctattttaaaaacagagctgtgaggttaggagttctctagctgtgcttttccatctctgaatttgcagtaaaatccatttcccaag

SEQ ID NO: 156995 - DNA, 449 bp, Homo sapiens
  Payload ID: 10769
  Gene Symbol: MYH9
  Gene Name: myosin, heavy chain 9, non-muscle
  ENST ID: ENST00000456729
  CDS Start-End: 141-449
ggggctggtgttcggggctgccccgagcccagctctgggagcttattttgtcatcacagtggcactgcagcctgtctacctcctggctgcggctcgtcctcagatgccttctgtgaaggctgtcctggctataagtcaccatggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggag

SEQ ID NO: 156996 - DNA, 1065 bp, Homo sapiens
  Payload ID: 10770
  Gene Symbol: MYL1
  Gene Name: myosin, light chain 1, alkali
  skeletal, fast
  Uniprot ID: P05976
  ENST ID: ENST00000352451
  CDS Start-End: 149-733
tgcccttatgccgtttaacactctgggtccatcttcaagacactgggctgtggatcaacccaaccaccactcctcttccaagaatcattttgacaggttcttttggaggaactccttctctttttaacccacccttttaaaaaaaaaaatggcaccaaagaaagacgtgaagaaacctgtggctgcggctgcggctgccccagccccggcaccggcacctgcacctgcccctgccccagccaaacccaaagaagaaaaaattgacctctctgccattaagatcgagttctctaaggaacagcaggatgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaa

SEQ ID NO: 156997 - DNA, 870 bp, Homo sapiens
  Payload ID: 10770
  Gene Symbol: MYL1
  Gene Name: myosin, light chain 1, alkali
  skeletal, fast
  Uniprot ID: P05976
  ENST ID: ENST00000341685
  CDS Start-End: 86-538
ccagggatgaccccactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaa

SEQ ID NO: 156998 - DNA, 1009 bp, Homo sapiens
  Payload ID: 10771
  Gene Symbol: MYL10
  Gene Name: myosin, light chain 10, regulatory
  Uniprot ID: Q9BUA6
  ENST ID: ENST00000223167
  CDS Start-End: 179-859
ccatagcctgcctgtctgcatggtccgcctagaggtttgagcagctgggcatggaagaagcgagccacacccccatcgcatgccctatgaacgggataagggaactttttcacttcaccactatgcctgactaattttttaattaaaaaaaatttttttgtagaaacagagtttcaccatgttgcttaggctggtctcaaactcctggcctcaagtgatcctccctcctcggcctcccaaagtgctgggattacaggcaccgagaagagctcggaaaagagcagaaggcaccgccagctccaacgtcttctccatgtttgatcagtcccagatccaggagtttaaagagagtctggctctgtcgcccaggctggagcgcaatggcatgatctcggctcactgcaacctctgcctcacgggttcaagcaattctcctgcctcagcctcccaagctttcaccatcatggaccagaaccgtgatggcttcatcgacaaagaggacttgagggacacctttgccgcgctgggccgcatcaatgtcaagaacgaggaactggaggccatggtgaaggaggcccccggacccatcaacttcacggtgttcctgaccatgtttggggagaagctgaagggcacggacccagaggagaccattctccacgccttcaaagtgttcgacactgaagggaaaggtttcgtcaaggccgatgtcatcaaagaaaaacttatgacccaggcagaccgcttcagtgaggaggaggtcaagcagatgtttgcagcatttcccccagatgtgtgcggcaacctggactacagaaacctgtgctacgtcatcactcacggtgaagagaaggattaggggatcacaagtctccccgacattcaggggcagcaaacactgttgtggggtgtgacagggagctcttgcagccagaggctgcaggaaaaaggcttcccttgtcctacggttggggacaaagcaagaataaataatgctaatgaggtctga

SEQ ID NO: 156999 - DNA, 1229 bp, Homo sapiens
  Payload ID: 10772
  Gene Symbol: MYL12A
  Gene Name: myosin, light chain 12A, regulatory, non-sarcomeric
  Uniprot ID: P19105
  ENST ID: ENST00000217652
  CDS Start-End: 396-911
ggacgcaaccatctgcggaaaggataggggggaggaagacttaacactgcaacaacaggtacaaaaaagaaggaaactcagtaacaggacccagaggaccattatatattgctctatattctaggtcgcccactttacacttccttctcatgcacttggtcaataccacgcccgctgaccacactggcgacttccctctctgtcgcccctccgtgaagtcagacccactctgcgggccaagaaaggtgaccgggcttccttccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 157000 - DNA, 899 bp, Homo sapiens
  Payload ID: 10772
  Gene Symbol: MYL12A
  Gene Name: myosin, light chain 12A, regulatory, non-sarcomeric
  Uniprot ID: P19105
  ENST ID: ENST00000536605
  CDS Start-End: 67-582
gctgctgagcggttttgcagactaccatcttccctgcaactctgaaggatggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttatgataaaat

SEQ ID NO: 157001 - DNA, 947 bp, Homo sapiens
  Payload ID: 10772
  Gene Symbol: MYL12A
  Gene Name: myosin, light chain 12A, regulatory, non-sarcomeric
  Uniprot ID: P19105
  ENST ID: ENST00000579226
  CDS Start-End: 123-638
ccgcccttcgccgtgccctggaatgtgcggccaggcaaagccacaggacggacgcaaccatctgcggaaaggataggggggaggaagacttaacactgcaacaacaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttat

SEQ ID NO: 157002 - DNA, 334 bp, Homo sapiens
  Payload ID: 10772
  Gene Symbol: MYL12A
  Gene Name: myosin, light chain 12A, regulatory, non-sarcomeric
  ENST ID: ENST00000583449
  CDS Start-End: 298-334
gctcggagaggtgctcggattctcgtagctgtgccggcccacaatgattctgagctaaaacacaaaataaaaaccagattcattgccaccagcgctcacctcgcctgacttaaaaaaaagtttcgtacaacagacactccttgacaccaaggatctttcacttaatccctcaaaaataaagactcgagctgggtgcggtggctcacgcctgtaattccagcactttgggaggccgaggcaggtggatcacgaagtcaggagttcaagaccagcctgcacaaggacttaaccaccaccatgtcgagcaaaagaacaaagaccaagaccaagaagc

SEQ ID NO: 157003 - DNA, 623 bp, Homo sapiens
  Payload ID: 10772
  Gene Symbol: MYL12A
  Gene Name: myosin, light chain 12A, regulatory, non-sarcomeric
  ENST ID: ENST00000578562
  CDS Start-End: 281-623
tagtgcctattttagacctgcttggaagaatataactcaatgcagtgtcttacttttgctgctgagcggttttgcagactaccatcttccctgcaactctgaaggatggtatggtagaattttattgtctgatgactgagatttttaacttgaaacaaatttttgtagtttttaacagattgagtattgaaaattgcctttttattttaggtattattagacattctttttaattttaacttaaattttaccgggataaatttaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactg

SEQ ID NO: 157004 - DNA, 1004 bp, Homo sapiens
  Payload ID: 10772
  Gene Symbol: MYL12A
  Gene Name: myosin, light chain 12A, regulatory, non-sarcomeric
  Uniprot ID: P19105
  ENST ID: ENST00000578611
  CDS Start-End: 196-711
gaagcggtggtttttagcggctctctgggtagcagggtggtgtgatagcggcagcgaggggctcggagaggtgctcggattctcgtagctgtgccggcccacaatgattctgagctaaaacacaaaataaaaaccagattcattgccaccagcgctcacctcgcctgacttaaaaaaaaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcagagaaagttattcgctcgattttttctgaat

SEQ ID NO: 157005 - DNA, 899 bp, Homo sapiens; identical to SEQ ID NO: 157000
  Payload ID: 10772
  Gene Symbol: MYL12A
  Gene Name: myosin, light chain 12A, regulatory, non-sarcomeric
  ENST ID: ENST00000580887
  CDS Start-End: 49-582

SEQ ID NO: 157006 - DNA, 1210 bp, Homo sapiens
  Payload ID: 10773
  Gene Symbol: MYL12B
  Gene Name: myosin, light chain 12B, regulatory
  Uniprot ID: O14950
  ENST ID: ENST00000237500
  CDS Start-End: 345-863
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccacttggtcccgccgcgccttccggtgcgccttccggtgcgccttccggtgcgccttccgctccgccccttcaggcaggaagtgtcggcgccgccactgtccggccacagcctaacgctcttcgctgtcgtttgtggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaatgtaa

SEQ ID NO: 157007 - DNA, 1025 bp, Homo sapiens
  Payload ID: 10773
  Gene Symbol: MYL12B
  Gene Name: myosin, light chain 12B, regulatory
  Uniprot ID: O14950
  ENST ID: ENST00000400175
  CDS Start-End: 160-678
ctgccctcccggcgccgcggcgggtcctggcggtggattggggccgacccgggcgtgttcgtgtggagcacctgccctgtgcccaacactatcctagatgctttggagggtggaggagcctcctgttgcacggtcttgcctaagaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaatgtaa

SEQ ID NO: 157008 - DNA, 1249 bp, Homo sapiens
  Payload ID: 10773
  Gene Symbol: MYL12B
  Gene Name: myosin, light chain 12B, regulatory
  Uniprot ID: O14950
  ENST ID: ENST00000581193
  CDS Start-End: 384-902
ggcgggaggagggttggtggcgaggccctggcccggacgtccaggggccgggaggctgcaggcgatggagccggtatggggagacgccctgctggagaagtggccgggtcccggccgtgcgtgggccggccctgcgccacctgggtgacctcagacacctgggccttggacggcccggctgcccggcggccaacgcctgccctcccggcgccgcggcgggtcctggcggtggattggggccgacccgggcgtgttcgtgtggagcacctgccctgtgcccaacactatcctagatgctttggagggtggaggagcctcctgttgcacggtcttgcctaaggtgaagcctccaaggaagccattagcataattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaatgtaa

SEQ ID NO: 157009 - DNA, 1064 bp, Homo sapiens
  Payload ID: 10773
  Gene Symbol: MYL12B
  Gene Name: myosin, light chain 12B, regulatory
  Uniprot ID: O14950
  ENST ID: ENST00000584539
  CDS Start-End: 199-717
actgaaggccttggattcaaccttaagagggagaacttagcgtttccggctagatgtgtgggaggtggtaacgagcaaaactcaaaagctgggaattgtgtcctgtgaaaagcaggccgtggggacaccggcgggtatggaacagaactgtaatgactaatagtcggaaataagggtagatagaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaatgtaa

SEQ ID NO: 157010 - DNA, 807 bp, Homo sapiens
  Payload ID: 10774
  Gene Symbol: MYL2
  Gene Name: myosin, light chain 2, regulatory, cardiac, slow
  Uniprot ID: P10916
  ENST ID: ENST00000228841
  CDS Start-End: 49-549
gcggagtgtggaattcttctcgggaggcagtgctgggtcctttccaccatggcacctaagaaagcaaagaagagagccgggggcgccaactccaacgtgttctccatgttcgaacagacccaaatccaggaatttaaggaggccttcactatcatggaccagaacagggatggcttcattgacaagaacgatctgagagacacctttgctgcccttgggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatgggtacttcgtggccgcacatcctacagttggaaatccatccagaggccatgttccaataaacaggaggtcgtgtatttggtcacgacatttctctgacaaa

SEQ ID NO: 157011 - DNA, 664 bp, Homo sapiens
  Payload ID: 10774
  Gene Symbol: MYL2
  Gene Name: myosin, light chain 2, regulatory, cardiac, slow
  ENST ID: ENST00000548438
  CDS Start-End: 47-505
ggagtgtggaattcttctcgggaggcagtgctgggtcctttccaccatggcacctaagaaagcaaagaagagagccgggggcgccaactccaacgtgttctccatgttcgaacagacccaaatccaggaatttaaggagctcggagtccctgagtgtgtgtttcctaccctagggcgagtgaacgtgaaaaatgaagaaattgatgaaatgatcaaggaggctccgggtccaattaactttactgtgttcctcacaatgtttggggagaaacttaagggagcggaccctgaggaaaccattctcaacgcattcaaagtgtttgaccctgaaggcaaaggggtgctgaaggctgattacgttcgggaaatgctgaccacgcaggcggagaggttttccaaggaggaggttgaccagatgttcgccgccttcccccctgacgtgactggcaacttggactacaagaacctggtgcacatcatcacccacggagaagagaaggactaggagggggctcgctgctgcgccctgggctcgtctttgcagagtggtccctgccctcatctctctcccccgagtaccgcctctgtccctaccttgtctgttagccatgtggctgccccatttatccacctccatcttctttgcagcctgggtggctatggg

SEQ ID NO: 157012 - DNA, 924 bp, Homo sapiens
  Payload ID: 10775
  Gene Symbol: MYL3
  Gene Name: myosin, light chain 3, alkali
  ventricular, skeletal, slow
  Uniprot ID: P08590
  ENST ID: ENST00000292327
  CDS Start-End: 94-681
atccgggcaggataaaggcctgggtgaggcggctcacctaccctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacacctgagcagattgaagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggccttcc

SEQ ID NO: 157013 - DNA, 1012 bp, Homo sapiens
  Payload ID: 10775
  Gene Symbol: MYL3
  Gene Name: myosin, light chain 3, alkali
  ventricular, skeletal, slow
  Uniprot ID: P08590
  ENST ID: ENST00000395869
  CDS Start-End: 53-640
cctgctttctgcattcttctctccacatccctctctgtacttacagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttcacacctgagcagattgaagagttcaaggaagccttcatgctgttcgaccgcacacccaagtgtgagatgaagatcacctacgggcagtgtggggatgtcctgcgggcgctgggccagaaccccacacaggcagaagtgctccgtgtcctggggaagccaagacaggaagagctcaataccaagatgatggactttgaaactttcctgcctatgctccagcacatttccaagaacaaggacacaggcacctatgaggacttcgtggaggggctgcgggtcttcgacaaggagggcaatggcactgtcatgggtgctgagcttcgccacgtgctggccacgctgggtgagaggctgacagaagacgaagtggagaagttgatggctgggcaagaggactccaatggctgcatcaactatgaagcatttgtgaagcacatcatgtccagctaaacctcgtgcccaggtaggcacccactccctcctgaacccgctgctgccacctgcccacactccaccagctgcagtgctcacttgacatcctgctgcctccgtctccctcctcctctgtaatctgcactgcctttgctctcaggaagcccagggaaggctgtgcagggacgtctcatctcccatgtgtgatgctgacaccagcggcctggagtcgtgggaaggaggggagccttaccaagactcctgcaaaaacccttggacctctccacgtggttgccgtctctggcccctctcaggctgtgcttacctgtgacagcagctctgtccccaccccatgggcctcatgaataaatggcttcttgccggccttcc

SEQ ID NO: 157014 - DNA, 451 bp, Homo sapiens
  Payload ID: 10775
  Gene Symbol: MYL3
  Gene Name: myosin, light chain 3, alkali
  ventricular, skeletal, slow
  ENST ID: ENST00000431168
  CDS Start-End: 314-451
gacgcgggagtgtggagaggccgagaggagccttccgccccccgccccgggacattgcgctagaggccgaggcccggagtcttacggcggcgggatgtcctgggaaaatgtagctgtggaagagcagaacattcctccctcctgtgatggctgacattcataggaaggcggacacacggaagacgccaggtaacaagagcccagaagaaggccggcgtggccgggctttcctgccttagtccacaggctcctcagaagtcagggcccatatcttccccgcattctccttggctgggggaagggagagcccccaatggcccccaaaaagccagagcccaagaaggatgatgccaaggcagcccccaaggcagctccagctcccgcacctccccctgagcctgagcgccctaaggaggtcgagtttgatgcttccaagatcaagattgagttc

SEQ ID NO: 157015 - DNA, 907 bp, Homo sapiens
  Payload ID: 10776
  Gene Symbol: MYL4
  Gene Name: myosin, light chain 4, alkali
  atrial, embryonic
  Uniprot ID: P12829
  ENST ID: ENST00000354968
  CDS Start-End: 129-722
ctctctggctgctccggcatatttgagaaggtctgtttccctggtccttctgggtttccaccaattggcaagaagggatcagcctgtcctagagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctg

SEQ ID NO: 157016 - DNA, 855 bp, Homo sapiens
  Payload ID: 10776
  Gene Symbol: MYL4
  Gene Name: myosin, light chain 4, alkali
  atrial, embryonic
  Uniprot ID: P12829
  ENST ID: ENST00000393450
  CDS Start-End: 76-669
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctga

SEQ ID NO: 157017 - DNA, 650 bp, Homo sapiens
  Payload ID: 10776
  Gene Symbol: MYL4
  Gene Name: myosin, light chain 4, alkali
  atrial, embryonic
  ENST ID: ENST00000536623
  CDS Start-End: 61-650
ctggctgctccggcatatttgagaagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagg

SEQ ID NO: 157018 - DNA, 582 bp, Homo sapiens
  Payload ID: 10776
  Gene Symbol: MYL4
  Gene Name: myosin, light chain 4, alkali
  atrial, embryonic
  ENST ID: ENST00000570772
  CDS Start-End: 128-313
tctctggctgctccggcatatttgagaaggtctgtttccctggtccttctgggtttccaccaattggcaagaagggatcagcctgtcctagagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccacc

SEQ ID NO: 157019 - DNA, 641 bp, Homo sapiens
  Payload ID: 10776
  Gene Symbol: MYL4
  Gene Name: myosin, light chain 4, alkali
  atrial, embryonic
  ENST ID: ENST00000576874
  CDS Start-End: 125-641
ctggctgctccggcatatttgagaaggtctgtttccctggtccttctgggtttccaccaattggcaagaagggatcagcctgtcctagagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagc

SEQ ID NO: 157020 - DNA, 920 bp, Homo sapiens
  Payload ID: 10776
  Gene Symbol: MYL4
  Gene Name: myosin, light chain 4, alkali
  atrial, embryonic
  ENST ID: ENST00000571981
  CDS Start-End: 176-361
tggttgtcttagcatcctgcattctagtctcaggtcggtcataactcagtgtgacgttgggcaagtcacccccttctctctggacctctgaagttccttgtagctgttagcatatctgggatgatgcagtttggatgactgatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctggg

SEQ ID NO: 157021 - DNA, 640 bp, Homo sapiens
  Payload ID: 10776
  Gene Symbol: MYL4
  Gene Name: myosin, light chain 4, alkali
  atrial, embryonic
  ENST ID: ENST00000573747
  CDS Start-End: 82-429
gctcctatctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccag

SEQ ID NO: 157022 - DNA, 740 bp, Homo sapiens
  Payload ID: 10776
  Gene Symbol: MYL4
  Gene Name: myosin, light chain 4, alkali
  atrial, embryonic
  ENST ID: ENST00000570671
  CDS Start-End: 1-305
tgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgagtgcagcctctccctcctggtcccttccggggtcacatagggccttaagaataacaccatgtgccctagaaggcatctgtcccagccctgaccccttaagaggaaacctcttgggatcaggaagtgaggacagccctgctcactcaccatctcctgtctcctgcctgcccttgcctgttcaccctgtcttgaccctatcagtcacatcctcttgcctctcccaggatctctcaaggcaatgcccttccctcaggcctggggcctcctgtacaggctcctgggagtgagaaagccgatcccaagtggaagagaaggtccctggcctgtgctcttgaccccgttcttcctcacttctttccctaggttttccctgggatccccctgggtgtggtaaggggctgggtctaggagggtga

SEQ ID NO: 157023 - DNA, 850 bp, Homo sapiens
  Payload ID: 10776
  Gene Symbol: MYL4
  Gene Name: myosin, light chain 4, alkali
  atrial, embryonic
  Uniprot ID: P12829
  ENST ID: ENST00000572316
  CDS Start-End: 92-685
gcttatcaactgctcaagtcagctcatctctctggctgctccggcatatttgagaagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggcca

SEQ ID NO: 157024 - DNA, 544 bp, Homo sapiens
  Payload ID: 10776
  Gene Symbol: MYL4
  Gene Name: myosin, light chain 4, alkali
  atrial, embryonic
  ENST ID: ENST00000572303
  CDS Start-End: 24-544
gccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaaggtgagtatggacaaccccacctctccgtctctattgcactttcctggaggaggaggaggaggaggaagaagaggaggagtagttgtcctcatgagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttga

SEQ ID NO: 157025 - DNA, 666 bp, Homo sapiens
  Payload ID: 10777
  Gene Symbol: MYL5
  Gene Name: myosin, light chain 5, regulatory
  Uniprot ID: Q02045
  ENST ID: ENST00000400159
  CDS Start-End: 106-627
ggagtggcagccggagtctgaactgtcctgggggaccaagcaggagcttaagatgggcaagacctggggccctgggcagacgcatcaaagcaggcagaagcaggcatggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacgcttggaccctg

SEQ ID NO: 157026 - DNA, 731 bp, Homo sapiens
  Payload ID: 10777
  Gene Symbol: MYL5
  Gene Name: myosin, light chain 5, regulatory
  ENST ID: ENST00000513662
  CDS Start-End: 74-391
ggaccaagcaggagcttaagatgggcaagacctggggccctgggcagacgcatcaaagcaggcagaagcaggcatggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggtaggtacccaggcagaacgcctcagagcccttggaggaggcgaacacagaggtcctccagctccagacgccgcggcccctcctcgaatggagccagggcccgcgcctcagaggcccaccaacggccctgaagctgcaaggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggagga

SEQ ID NO: 157027 - DNA, 584 bp, Homo sapiens
  Payload ID: 10777
  Gene Symbol: MYL5
  Gene Name: myosin, light chain 5, regulatory
  Uniprot ID: Q02045
  ENST ID: ENST00000505477
  CDS Start-End: 158-556
aggaacagggcggagtagcggccgagctgcgaaagaggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacg

SEQ ID NO: 157028 - DNA, 1780 bp, Homo sapiens
  Payload ID: 10777
  Gene Symbol: MYL5
  Gene Name: myosin, light chain 5, regulatory
  ENST ID: ENST00000503300
  CDS Start-End: 1209-1403
gcgtgaggcgggatctgcgccgagtgggcggggggtttcctttccccgcagggctgggggtccgctgtttccccgcgctgctgccgaggccccgccgtccgcgtcctggccgtgtgtccacaccccagactgcgggccggggcgcactctgtcttcttgcgcggagcgtcggaggcctgaggtcagggcggctcgggcgggtccagccccgcggaccgcgcccacccgagggtggcctgggcagggacctgggggtcctgggagcggagtgtgagccgagtgcaggtggctccccgggcaggtccttctcctacaaggcagtagtgtctgtcgccggccgggccgcgttggattccgcggcccgcgggagcatggcctccaggcccctcttcctgcggctgctctgcccgggagcacggggcgcccttcatcccggagctggagcttcctcaccccaggatgccccatcacttctgtcccgaagaggggctgggatcttcttgggaagaccagcccccaacagaggctgctccctgggtcccccgactccaggcctcaggactccacggctccaagggcctgccccggcccaggcctggggaccactgagccccacactggtctttgctggcctctgtccacctcccggtagctgtgtgtctcccacagctgcccagagatggggcctgcggtgcctatgcagcctccccgctgtgcccgaagtgctgacccgccagccccatggacaccaggcttggagtctaggcaggagcctggcaccccctccacgttctgggtcttcctggcggcagccatgctgcccgtgctgggccaccctcgggccccctttggccccatgcagtagtgacgcaaggcctcctgtgtcccctcctggccctgcactgctacaggcagaagcaactggagaactatggctcgggtctcgctaagggggccagaagcaaactccagccctccccgtgtctactgctcgctgaggaagccgcaggtgcacactggatccacaaggcacagaaccatcttggccctcggcaagcccccgcttccgccagggcagacggcctcaggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggtaggtacccaggcagaacgcctcagagcccttggaggaggcgaacacagaggtcctccagctccagacgccgcggcccctcctcgaatggagccagggcccgcgcctcagaggcccaccaacggccctgaagctgcaaggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacgcttgg

SEQ ID NO: 157029 - DNA, 781 bp, Homo sapiens
  Payload ID: 10777
  Gene Symbol: MYL5
  Gene Name: myosin, light chain 5, regulatory
  Uniprot ID: Q02045
  ENST ID: ENST00000511290
  CDS Start-End: 349-747
gggtccgctgtttccccgcgctgctgccgaggccccgccgtccgcgtcctggccgtgtgtccacaccccagactgcgggccggggcgcactctgtcttcttgcgcggagcgtcggaggcctgaggtcagggcggctcgggcgggtccagccccgcggaccgcgcccacccgagggtggcctgggcagggacctgggggtcctgggagcggagtgtgagccgagtgcaggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacgcttgga

SEQ ID NO: 157030 - DNA, 2956 bp, Homo sapiens
  Payload ID: 10777
  Gene Symbol: MYL5
  Gene Name: myosin, light chain 5, regulatory
  Uniprot ID: Q02045
  ENST ID: ENST00000506838
  CDS Start-End: 2525-2923
acagggcccctgctgcccacccgctcacgcactggctcactcgtcctctgcgaacagggactgcctcccatcaagacctcagcactcgaacagccatttagcacccgttttcaccaagaagcagccgttttcgagtcccccgcccgggcctcagaagcctgagctttgggtgagctgattccactatcggggtcacgctcggtggaggacacggtcctgcagcctcgcatgcgtcccaagcccccttccagagctggagttctccaaatagcacaggagctccacaggaaagccgagcagaccccgccccggccccgcccgcggtcactcactgtagcgcgtggctccgtaggccacaccgaggaacagggcggagtagcggccgagctgcgaaagaggttggtcagaggcggcgcgaaacggggctcgcgggacgggggtcgcgggaggagggggggcggggtcgctgggcagaggtcgcaggaggggtgggggtccggtcgccgggcgagggtcacggggcgaggatcatgggggcgggggccgggggtcgcagcccgcggggtcggagctgcggggcgggacacgggggggcccagagcactgggcggcggctgcaaagcctggatcaccttgatgagcggagagacctgcaccggtggcaccatcttgtccctgacctccgcaccggaagcacaacctgcagacggagcaggatgccgcacaagccagcaaagccttggaggcaaaggcggagctgggcgcacgcatgcgccgtcagcggcgagagagcggggggccgcgccccctggcgaccgaagggtgactgcgcgcccccgcgcggcggtgacgtcacgtgaggcgcacgcgcacaaaggctggggagtgcgcggaggatcatcggctgcgcctgcgcagttgctgcgtgaggcgggatctgcgccgagtgggcggggggtttcctttccccgcagggctgggggtccgctgtttccccgcgctgctgccgaggccccgccgtccgcgtcctggccgtgtgtccacaccccagactgcgggccggggcgcactctgtcttcttgcgcggagcgtcggaggcctgaggtcagggcggctcgggcgggtccagccccgcggaccgcgcccacccgagggtggcctgggcagggacctgggggtcctgggagcggagtgtgagccgagtgcaggtggctccccgggcaggtccttctcctacaaggcagtagtgtctgtcgccggccgggccgcgttggattccgcggcccgcgggagcatggcctccaggcccctcttcctgcggctgctctgcccgggagcacggggcgcccttcatcccggagctggagcttcctcaccccaggatgccccatcacttctgtcccgaagaggggctgggatcttcttgggaagaccagcccccaacagaggctgctccctgggtcccccgactccaggcctcaggactccacggctccaagggcctgccccggcccaggcctggggaccactgagccccacactggtctttgctggcctctgtccacctcccggtagctgtgtgtctcccacagctgcccagagatggggcctgcggtgcctatgcagcctccccgctgtgcccgaagtgctgacccgccagccccatggacaccaggcttggagtctaggcaggagcctggcaccccctccacgttctgggtcttcctggcggcagccatgctgcccgtgctgggccaccctcgggccccctttggccccatgcagtagtgacgcaaggcctcctgtgtcccctcctggccctgcactgctacaggcagaagcaactggagaactatggctcgggtctcgctaaggtgcagcatcacaaactccaggactcttgaagcaagcatggggaggacccgtgatcctggcggcctgggctacctgtccgggcctaagtcgcctctgccccctctcctggcttgctctggggtccagggcctgggcctctctggctgagaaactaggaagtcactgggctctgtttcctgagctgggtataccaaggccagtcctatagggcaggggtccccaacccccaggtgcagaccagtaccagcttgtggcccgttaggaaccgggcagcacaggacgaggtgagggagcatgattgcccgagctccacccactttcagatcagcctgggcatcagattcccataggagcgtgaaccctactgtgagctgcgcacttggatctggattgcgctctgggggccagaagcaaactccagccctccccgtgtctactgctcgctgaggaagccgcaggtgcacactggatccacaaggcacagaaccatcttggccctcggcaagcccccgcttccgccagggcagacggcctcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaacaaggagtacatcaagcgtctgctgatgtcccaggctgacaagatgacggcggaagaggtggaccagatgttccagttcgcctccatcgatgtggcgggcaacctggactacaaggcgctcagctacgtgatcacccacggggaggagaaggaggagtgagacccagccgggtcaataaacctggacgcttgg

SEQ ID NO: 157031 - DNA, 829 bp, Homo sapiens
  Payload ID: 10777
  Gene Symbol: MYL5
  Gene Name: myosin, light chain 5, regulatory
  ENST ID: ENST00000507804
  CDS Start-End: 452-829
tatgtgcgtgtgtgtgaccttgcgggtgtgggctgtgctgtgttgtgggaagtacgtgcctcacgttgctctcctggtgagagtccggagcaggatgagggggttcctggctttcacaaaatcccggtacccagaacaagcccacccagagtccacttgcccctcaagccttcagaggccaagctggctcctgctggacggcgatccctgaccactgtgctctgtgggccttctggaagccactgtccctcccccagtccctgtgctgaagccagacacctgcagccgtcctgcccccaaccccagctacccaggcctgaggctggcatgctcctcagctgtctggccccctccagcccgaagggctgaggtccacccttcatctgagttaagtctctcaaaactctgggtgccctggagggtttcgtcagccagcccaggaccctcagccatggtgctcccaccgcaggccagcaggaagaccaagaagaaggaagggggtgccctccgggcccagagagcctcatccaatgtcttctccaactttgagcagactcagatccaggagttcaaggaggcattcacactcatggatcagaaccgagatggcttcattgacaaggaggacctgaaggacacctatgcctccctgggcaagaccaacgtcaaggacgacgagctggacgccatgctcaaagaggcctcggggcccatcaacttcaccatgtttctgaacctgtttggggagaagctgagcggtaccgacgccgaggagaccattcttaacgccttcaagatgctggacccggacgggaaagggaaaatcaac

SEQ ID NO: 157032 - DNA, 664 bp, Homo sapiens
  Payload ID: 10778
  Gene Symbol: MYL6
  Gene Name: myosin, light chain 6, alkali, smooth muscle and non-muscle
  ENST ID: ENST00000293422
  CDS Start-End: 47-505
ggagccattactgcaggaaaaggtcccggagagctgagcagtcaagatgcagtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggg

SEQ ID NO: 157033 - DNA, 722 bp, Homo sapiens
  Payload ID: 10778
  Gene Symbol: MYL6
  Gene Name: myosin, light chain 6, alkali, smooth muscle and non-muscle
  ENST ID: ENST00000348108
  CDS Start-End: 47-505
ggagccattactgcaggaaaaggtcccggagagctgagcagtcaagatgcagtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggccctcggttcggt

SEQ ID NO: 157034 - DNA, 1221 bp, Homo sapiens
  Payload ID: 10778
  Gene Symbol: MYL6
  Gene Name: myosin, light chain 6, alkali, smooth muscle and non-muscle
  ENST ID: ENST00000536128
  CDS Start-End: 41-757
attactgcaggaaaaggtcccggagagctgagcagtcaagatggtggggcccaggtcttgggagacgggcaggattggggacgagaggcaggaagagacgggtggggggcgaggagaaggcaggggtaggaggcaaagggaatctgaggacccgaaaggttggaggtggggttggaaagactggggccctgcggggaagcgagtctgcagcctgaaacaggagtttgtgggtcagagtttgtgggtcagagtttgtggggctgggatagaaactcgggggattggcgttcagatgctgaccacttccctcttctctgagcagtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaaggtaagaggtgaactgcgctttctcagagaaagcagccatatggggcaggtcaagtatagtgtctggggctttccctatccctggacttgggctccaaaaagagccaggaggcaaggtgcagggccctgcccagcccagcccaggagtgggaggtcagggcggtataacaggaaaggaagggggtagtattgtagagggtgggaaggaatgagaagtgaaataatggaatgtctgtccccactgcctgacccctcaccccatgtctttgtcttgtcttcaccatgaatgtctcttccttcctgcagcgtttgtgaggcatatcctgtcggggtgacgggcccatggggcgggtacggctcctcccagcctctcctctagttgatctccccagtgtttcttttttccccaacctgtgctctttatcccctgcccttaccctactaccatctgacttcctcctggcatgtttctgcat

SEQ ID NO: 157035 - DNA, 528 bp, Homo sapiens
  Payload ID: 10778
  Gene Symbol: MYL6
  Gene Name: myosin, light chain 6, alkali, smooth muscle and non-muscle
  ENST ID: ENST00000548580
  CDS Start-End: 57-368
gccgagagtcggagccattactgcaggaaaaggtcccggagagctgagcagtcaagatgtgtgacttcaccgaagaccagaccgcagagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggc

SEQ ID NO: 157036 - DNA, 1438 bp, Homo sapiens
  Payload ID: 10778
  Gene Symbol: MYL6
  Gene Name: myosin, light chain 6, alkali, smooth muscle and non-muscle
  ENST ID: ENST00000551589
  CDS Start-End: 34-471
caggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaaggtaagaggtgaactgcgctttctcagagaaagcagccatatggggcaggtcaagtatagtgtctggggctttccctatccctggacttgggctccaaaaagagccaggaggcaaggtgcagggccctgcccagcccagcccaggagtgggaggtcagggcggtataacaggaaaggaagggggtagtattgtagagggtgggaaggaatgagaagtgaaataatggaatgtctgtccccactgcctgacccctcaccccatgtctttgtcttgtcttcaccatgaatgtctcttccttcctgcagcgtttgtgaggcatatcctgtcggggtgacgggcccatggggcgggtacggctcctcccagcctctcctctagttgatctccccagtgtttcttttttccccaacctgtgctctttatcccctgcccttaccctactaccatctgacttcctcctggcatgtttctgcatggagctgactagggaggggagggattcctcaaagaggaagacaacctgggggtacagtacctccttacctctagaatgggccctgaggttttacttatgcggccctgggtgctggtgtctgggaactctcaccagcctgtataccagtcttgctttagggtgaccttctggccctggagcatgggtagctggcatagaggggtatgggttgcctgccccattctgctgctatagctgaacagtcctttccccttccctcgctgggcagcttggaggtaccctaacccaaaactctgtcctctcctcccgccagtggctgacagtagctgtaggtgtagtggagaacttttctgcctctgctgtgttcttgctgcttaggtttgggtgggggactaacagctgctgggaggggagctaggggcatggagaactggtcagactcaaggtggctcctctgcaaactgaccccagggttggttgctgtgggcatgttcccgcttatg

SEQ ID NO: 157037 - DNA, 685 bp, Homo sapiens
  Payload ID: 10778
  Gene Symbol: MYL6
  Gene Name: myosin, light chain 6, alkali, smooth muscle and non-muscle
  ENST ID: ENST00000549566
  CDS Start-End: 45-635
agccattactgcaggaaaaggtcccggagagctgagcagtcaagatggtggggcccaggtcttgggagacgggcaggattggggacgagaggcaggaagagacgggtggggggcgaggagaaggcaggggtaggaggcaaagggaatctgaggacccgaaaggttggaggtggggttggaaagactggggccctgcggggaagcgagtctgcagcctgaaacaggagtttgtgggtcagagtttgtgggtcagagtttgtggggctgggatagaaactcgggggattggcgttcagatgctgaccacttccctcttctctgagcagtgtgacttcaccgaagaccagaccgcagagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttg

SEQ ID NO: 157038 - DNA, 655 bp, Homo sapiens
  Payload ID: 10778
  Gene Symbol: MYL6
  Gene Name: myosin, light chain 6, alkali, smooth muscle and non-muscle
  Uniprot ID: P60660
  ENST ID: ENST00000547649
  CDS Start-End: 41-496
attactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggg

SEQ ID NO: 157039 - DNA, 683 bp, Homo sapiens
  Payload ID: 10778
  Gene Symbol: MYL6
  Gene Name: myosin, light chain 6, alkali, smooth muscle and non-muscle
  ENST ID: ENST00000547408
  CDS Start-End: 35-520
gcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaaggtaaacgccgctgtgaaggactccaggaaagctgctcccatcacaatccccctgcctgacagccacaggagtccatggatacagcccagggaaggaaggagaacagcccccagtgccctttcttctcctattacctaccacagaaatccccgaaattaggttttccccaccaaatacacatacgctgacatcaactaagcaagtgacttttaaaaacaaaac

SEQ ID NO: 157040 - DNA, 901 bp, Homo sapiens
  Payload ID: 10778
  Gene Symbol: MYL6
  Gene Name: myosin, light chain 6, alkali, smooth muscle and non-muscle
  Uniprot ID: P60660
  ENST ID: ENST00000550697
  CDS Start-End: 242-697
ctccccccacgaccccccccacctccgagcgggttctgtgcccaggtggcgctggagaaaggaacagcggaccccgcccaagtcattactaatgtagcaatcgtctgcataaacccaggccacggttcctattggctgagtcctctgagggtgacgtcatcgggacgtactaagactagggttgggccgagagtcggagccattactgcaggaaaaggtcccggagagctgagcagtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggg

SEQ ID NO: 157041 - DNA, 753 bp, Homo sapiens
  Payload ID: 10778
  Gene Symbol: MYL6
  Gene Name: myosin, light chain 6, alkali, smooth muscle and non-muscle
  Uniprot ID: P60660
  ENST ID: ENST00000548293
  CDS Start-End: 7-462
gtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcgggtacggctcctcccagcctctcctctagttgatctccccagtgtttcttttttccccaacctgtgctctttatcccctgcccttaccctactaccatctgacttcctcctggcatgtttctgcatggagctgactagggaggggagggattcctcaaagaggaagacaacctgggggtacagtacctccttacctctagaatgggccctgaggttttacttatgcggccctgggtgctggtgtctgggaactctcaccagcctgtataccagtct

SEQ ID NO: 157042 - DNA, 452 bp, Homo sapiens
  Payload ID: 10778
  Gene Symbol: MYL6
  Gene Name: myosin, light chain 6, alkali, smooth muscle and non-muscle
  ENST ID: ENST00000546845
  CDS Start-End: 1-250
gaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaaggtaaacgccgctgtgaaggactccaggaaagctgctcccatcacaatccccctgcctgacagccacaggggagaagctgggacacgtggagcaggaatgcgggaagcagagttgagctgcgagccaagggttggtccaacccaaggagtccatggatacagcccagggaaggaaggagaacagcccccagtgccctttcttctcctattacctaccacagaaatccccgaaattaggttttccccaccaaatacacatacg

SEQ ID NO: 157043 - DNA, 573 bp, Homo sapiens
  Payload ID: 10778
  Gene Symbol: MYL6
  Gene Name: myosin, light chain 6, alkali, smooth muscle and non-muscle
  ENST ID: ENST00000548400
  CDS Start-End: 21-368
cggagagctgagcagtcaagatgtgtgacttcaccgaagaccagaccgcagagttcaaggaggccttccagctgtttgaccgaacagagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggc

SEQ ID NO: 157044 - DNA, 502 bp, Homo sapiens
  Payload ID: 10778
  Gene Symbol: MYL6
  Gene Name: myosin, light chain 6, alkali, smooth muscle and non-muscle
  ENST ID: ENST00000549017
  CDS Start-End: 200-343
gagccattactgcaggaaaaggtcccggagagctgagcagtcaagatgtgtgacttcaccgaagaccagaccgcagagttcaaggaggccttccagctgtttgaccgaacagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctggg

SEQ ID NO: 157045 - DNA, 411 bp, Homo sapiens
  Payload ID: 10778
  Gene Symbol: MYL6
  Gene Name: myosin, light chain 6, alkali, smooth muscle and non-muscle
  ENST ID: ENST00000549392
  CDS Start-End: 21-411
cggagagctgagcagtcaagatgtgtgacttcaccgaagaccagaccgcaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaag

SEQ ID NO: 157046 - DNA, 1034 bp, Homo sapiens
  Payload ID: 10779
  Gene Symbol: MYL6B
  Gene Name: myosin, light chain 6B, alkali, smooth muscle and non-muscle
  Uniprot ID: P14649
  ENST ID: ENST00000550443
  CDS Start-End: 304-930
agtcaccaaccaccgccatgggccggaagccaccgccctcgcgtcaactgcaatctagagcgcggcgcatcccgtgagcccgcggggaactacgactcccggcatgctccgcggccaccggaattaacccttcagggctgggggccgcgctatgccccgccccctccccagccccagacacggaccccgcaggccaactggctccctgcccctgcccccgccccttgacatcccagactccctggctatttaaacagagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcaggcgaaagcacgttccagccaccaggaggccacctattgtttcaaaataaagactgggttcctc

SEQ ID NO: 157047 - DNA, 703 bp, Homo sapiens
  Payload ID: 10779
  Gene Symbol: MYL6B
  Gene Name: myosin, light chain 6B, alkali, smooth muscle and non-muscle
  ENST ID: ENST00000552568
  CDS Start-End: 72-599
cagccccagacacggaccccgcaggagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggagagaagatgactgaggaggaggtggagaccgttctggcaggacacgaggacagcaacggctgcatcaactacgaggccttcttgaaacacatcctaagcgtctgagtgctgcagatccagtggggtccggacactgggccccgcaggcgaaagcacgttccagccaccaggaggccacctattgtttcaaaataaagactgggttcctc

SEQ ID NO: 157048 - DNA, 562 bp, Homo sapiens
  Payload ID: 10779
  Gene Symbol: MYL6B
  Gene Name: myosin, light chain 6B, alkali, smooth muscle and non-muscle
  ENST ID: ENST00000551834
  CDS Start-End: 476-562
atgccccgccccctccccagccccagacacggaccccgcaggttcacacaagcctccctggctgctacccctcaccccacccttcaagaagactaaagctgctggatcacctgctttgcctcaccacccccatctcagtgccactggcaagcatcctatcctcaccctggaggttaactacctcattctgggcagtctctggcttcctcccctacccctaaaggaaacattgttcttttctggtcagcctttggggataaggggacagagggaagaagaccttggggcaggagtcctgaaccataggaggccaggggagtgagggcaggcggttatatctctcctctacctcatctttgccacagccaactggctccctgcccctgcccccgccccttgacatcccagactccctggctatttaaacagagatgggtgcccccatccgcacactgtcctttggccaccggacatcatgcctcccaagaaggatgttcccgtgaagaaaccagcagggccctccatctccaaacctgctgctaagccagcagcagcaggggct

SEQ ID NO: 157049 - DNA, 1305 bp, Homo sapiens
  Payload ID: 10779
  Gene Symbol: MYL6B
  Gene Name: myosin, light chain 6B, alkali, smooth muscle and non-muscle
  Uniprot ID: P14649
  ENST ID: ENST00000553066
  CDS Start-End: 423-1049
ctttcagcagtaggtccaggaaaacagccgccccgccccctccacctcccgagactaggagcccgccagggttaagtaggagggataccctaggggccccgcagggtttttagggttggggtggattggaaattgttcattgcctttcagttccgggacataaagcgcgctggaaggacactgagtcaccaaccaccgccatgggccggaagccaccgccctcgcgtcaactgcaatctagagcgcggcgcatcccgtgagcccgcggggaactacgactcccggcatgctccgcggccaccggaattaacccttcagggctgggggccgcgctatgccccgccccctccccagccccagacacggaccccgcaggagatgggtgcccccatccgcacactgtcctttggccaccggacatcatgcctcccaagaaggatgttcccgtgaagaaaccagcagggccctccatctccaaacctgctgctaagccagcagcagcaggggctcctccagccaagaccaaagctgagccagctgtcccccaggcccctcagaaaacccaggagcctccagtcgatctctccaaagtggtgatcgagtttaacaaggaccagctggaggagttcaaggaggccttcgagctgtttgaccgagtgggggatggcaagatcctgtacagccagtgtggggacgtgatgagggccctgggccagaaccccaccaacgccgaggtgctcaaggtcctggggaaccccaagagtgatgagctgaagtcgcggcgtgtggactttgagactttcctgcccatgctccaggcagtggccaagaaccgaggccaaggcacatatgaggactacttggaggggtttcgtgtgtttgacaaggaggggaacggcaaagtcatgggagcagagctcagacatgttctcaccacccttggagagaagatgactgaggaggaggtggagaccgttctggcaggacacgaggacagcaacggctgcatcaactacgaggccttcttgaaacacatcctaagcgtctgagtgctgcaggtagggccctcccaccccttcgccgcgccttacgaggcaagtctcccgcccttctctcagccaacatagaaaagcagcggagttcattctgctgtccggttgctgcacgggctccagcgcttcgcaactttggtttttttccacagatccagtggggtccggacactgggccccgcaggcgaaagcacgttccagccaccaggaggccacctattgtttcaaaataaagactgggttcctctcttgg

SEQ ID NO: 157050 - DNA, 612 bp, Homo sapiens
  Payload ID: 10780
  Gene Symbol: MYL7
  Gene Name: myosin, light chain 7, regulatory
  Uniprot ID: Q01449
  ENST ID: ENST00000223364
  CDS Start-End: 28-555
gacagcagccacacctctgcagagagaatggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 157051 - DNA, 646 bp, Homo sapiens
  Payload ID: 10780
  Gene Symbol: MYL7
  Gene Name: myosin, light chain 7, regulatory
  ENST ID: ENST00000457314
  CDS Start-End: 1-594
gccagcaggaaggcggggacccggggcaaggtggcagccaccaagcaggcccaacgtggttcttccaacgtcttttccatgtttgaacaagcccagatacaggagttcaaagaagtctctcccccacctcccaccttccctagagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaat

SEQ ID NO: 157052 - DNA, 421 bp, Homo sapiens
  Payload ID: 10780
  Gene Symbol: MYL7
  Gene Name: myosin, light chain 7, regulatory
  ENST ID: ENST00000431289
  CDS Start-End: 1-116
ggaaggcggggacccggggcaaggtggcagccaccaagcaggcccaacgtggttcttccaacgtcttttccatgtttgaacaagcccagatacaggagttcaaagaaggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagtaagtatgggcccagccagatgaggagcaccgtggtggaagcagagagcggggtgaggcccctagtgaggggggctgcctgtgcttcggggccttacactgctctttggggtgcagccaacccttccct

SEQ ID NO: 157053 - DNA, 791 bp, Homo sapiens
  Payload ID: 10780
  Gene Symbol: MYL7
  Gene Name: myosin, light chain 7, regulatory
  ENST ID: ENST00000458240
  CDS Start-End: 290-736
aagaaaggctagcggtctcccaggtgctggcctttgggctgggggagcagagttttctgtgcttgtgttgggttgagggtggtccccagggagaggaagaggatcctggccctggctctcctgggaatgctctgggactgtgcatgatgggtggggtggggagactctgaggagttggggagaggacccctccctactcacagtgttgcaggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattgg

SEQ ID NO: 157054 - DNA, 516 bp, Homo sapiens
  Payload ID: 10780
  Gene Symbol: MYL7
  Gene Name: myosin, light chain 7, regulatory
  ENST ID: ENST00000447951
  CDS Start-End: 1-516
gccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctggcccctgtggccaggatggagggagggcggcctgggccttctgggggacacccagggtccctgtgtgcacctcatgccccacccccaccagggaaggtgagtgtcccagaggaggagctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtg

SEQ ID NO: 157055 - DNA, 547 bp, Homo sapiens
  Payload ID: 10780
  Gene Symbol: MYL7
  Gene Name: myosin, light chain 7, regulatory
  ENST ID: ENST00000457910
  CDS Start-End: 28-123
gacagcagccacacctctgcagagagaatggtgagtgcctgctggggaagaaaggctagcggtctcccaggtgctggcctttgggctgggggagcagagttttctgtgcttgtgttgggttgagggtggtccccagggagaggaagaggatcctggccctggctctcctgggaatgctctgggactgtgcatgatgggtggggtggggagactctgaggagttggggagaggacccctccctactcacagtgttgcaggccagcaggaaggcggggacccggggcaaggtggcagccaccaagcaggcccaacgtggttcttccaacgtcttttccatgtttgaacaagcccagatacaggagttcaaagaagccttcagctgtatcgaccagaatcgtgatggcatcatctgcaaggcagacctgagggagacctactcccagctgggtgcgtgcacccacctcccaccctgcgcactggggtccctactctgagctgctgggcgggtgggagtggctggggggacaggactctgctcccctgctt

SEQ ID NO: 157056 - DNA, 321 bp, Homo sapiens
  Payload ID: 10780
  Gene Symbol: MYL7
  Gene Name: myosin, light chain 7, regulatory
  ENST ID: ENST00000431007
  CDS Start-End: 1-321
gccagcaggaaggcggggacccggggcaaggtggcagccaccaagcaggcccaacgtggttcttccaacgtcttttccatgtttgaacaagcccagatacaggagttcaaagaaagctgggggctgctcccacctgaaggcccccatcccacaggccttcagctgtatcgaccagaatcgtgatggcatcatctgcaaggcagacctgagggagacctactcccagctggggaaggtgagtgtcccagaggaggagctggacgccatgctgcaagagggcaagggccccatcaacttcaccgtcttcctcacgctctttgg

SEQ ID NO: 157057 - DNA, 465 bp, Homo sapiens
  Payload ID: 10780
  Gene Symbol: MYL7
  Gene Name: myosin, light chain 7, regulatory
  ENST ID: ENST00000446581
  CDS Start-End: 1-408
ctggacgccatgctgcaagagggcaagggccccatcaacttcaccgtcttcctcacgctctttggggagaagctcaatgggacagaccccgaggaagccatcctgagtgccttccgcatgtttgaccccagcggcaaaggggtggtgaacaaggatgagttcaagcagcttctcctgacccaggcagacaagttctctccagctgaggtgaggctgcccagccccttcaatactcatccccagcaccttctctgggccttcacccatgacccagagcccagtaccagtgaggcagttgctggaagggtggagcagatgttcgccctgacacccatggacctggcggggaacatcgactacaagtcactgtgctacatcatcacccatggagacgagaaagaggaatgaggggcagggccaggcccacgggggggcacctcaataaactctgttgcaaaattggaa

SEQ ID NO: 157058 - DNA, 1024 bp, Homo sapiens
  Payload ID: 10781
  Gene Symbol: MYL9
  Gene Name: myosin, light chain 9, regulatory
  Uniprot ID: P24844
  ENST ID: ENST00000346786
  CDS Start-End: 92-448
gtccagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctgggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcttc

SEQ ID NO: 157059 - DNA, 2821 bp, Homo sapiens
  Payload ID: 10781
  Gene Symbol: MYL9
  Gene Name: myosin, light chain 9, regulatory
  Uniprot ID: P24844
  ENST ID: ENST00000279022
  CDS Start-End: 105-623
gcccccgcctggagtccagacccgacggccggcccagttccacgcacccagcgagcccaagcgccttctccgcaccagggaagccccacccaccagaagccaagatgtccagcaagcgggccaaagccaagaccaccaagaagcggccacagcgggccacatccaatgtcttcgcaatgtttgaccagtcccagatccaggagtttaaggaggctttcaacatgattgaccagaaccgtgatggcttcattgacaaggaggacctgcacgacatgctggcctcgctggggaagaaccccacagacgaatacctggagggcatgatgagcgaggccccggggcccatcaacttcaccatgttcctcaccatgtttggggagaagctgaacggcacggaccccgaggatgtgattcgcaacgcctttgcctgcttcgacgaggaagcctcaggtttcatccatgaggaccacctccgggagctgctcaccaccatgggtgaccgcttcacagatgaggaagtggacgagatgtaccgggaggcacccattgataagaaaggcaacttcaactacgtggagttcacccgcatcctcaaacatggcgccaaggataaagacgactaggccaccccagccccctgacaccccagcccccgccagtcacccctccccgcacacacccgtccataccagctccctgcccatgaccctcgctcagggatccccctttgaggggttagggtcccagttcccagtggaagaaacaggccaggagaagtgcgtgccgagctgaggcagatgttcccacagtgaccccagagccctgggctatagtctctgacccctccaaggaaagaccaccttctggggacatgggctggagggcaggacctagaggcaccaagggaaggccccattccggggctgttccccgaggaggaagggaaggggctctgtgtgccccccaggaggaagaggccctgagtcctgggatcagacaccccttcacgtgtatccccacacaaatgcaagctcaccaaggtcccctctcagtccccttccctacaccctgaccggccactgccgcacacccacccagagcacgccacccgccatgggagtgtgctcaggagtcgcgggcagcgtggacatctgtcccagagggggcagaatctccaatagaggactgagcactgcttctggtctgtgtgtctgtggctggggtgaagtaaggggaccccgggcctgaaaccctctcccaccttctcctgccatctccagttactgccctgctcctcccaccctggcccagggaaggactgggtgtcctccggccatatggtccctgaagcctctagggaccagagtccctagtaagtgggctctgtgctcagctgagaccagcaggggacaggggacggagggaatgggcctcatggccttctcagggcttgtgggaaagggaggaccatgggaatcaccacagccaatcccgtggagggttccaggcctcttggggggcagaggtcaggccacacagccctcaggactaaagctccgggttccagaagaacagggaggctccaacagtgatgaggcaggcgtcccagcagctcagggttggaggtgggaatgaggggtttcccagccccaggcaggtggagggcgagttcagccccaggaccaacagcatgggggccacagctttccatgtccctgtgtacgcagggcaggcagggccgggacccctgctactggtggatgatggggacactgatggcagtgcctggggcctaagaggggcagaaagagcgctgaatgactgagcagagagtccagaggggcatggactgcctgggtcacccaataggcctagggaagagtgagggccggacccaccccacctgaccccagcgagtggacccagcttggtcctgaggccttctccagaggtcacccagcgcaggcagccgcagcactcagcaaaggtcccagatcagggccaagggggagctgagcaccaggggaccctgtgcctgaccaggaggccctaacctcctgcaggcctcaacgccaggccctgctcagagctcggctgaaactcctcatcctggctccaaacagaggcccaaaagtccctggtatcaactccagaaggggcgagacccgaacaagttccaaaccaggcccaaatagtatcccaaactcagtcccaaacacattctcacccccggcagcaggctgcaggcctccagctacacacacggccctgggcaactctcagtctggccacccattcgatgctgccagccccaagggtgtgggaggggggtctcagagtgtcccagggtactggccacacatgcccgacaccagggtcataaggtcctctcagcagagccactgcagcaccaaaggcatttctggaaggaggcaaggacgcgtcatctagatgtcaagccccagcgtgcgattctgtcacagttcaccccaccttcaccccgagacggaagacggaagagcttcgcacacaggcgggaagaggtcaggaccagtccagcctcactggcttcagaactggcctgggggctaccttgacccacaggaagggaagaggaacgtgctctgggcagggcaaggcaggacctgcagcacccacagaccagcagtaaaggacccccggaactttccaagtctagcacaaaacccagaagccacaaaggaaaatactggcagatttaaatgcatgaagtcaacattctttttgtagagctaaagaaaccataagcaaaattaaaagccaaatgcattctgggaggaaa

SEQ ID NO: 157060 - DNA, 2822 bp, Homo sapiens
  Payload ID: 10782
  Gene Symbol: MSTN
  Gene Name: myostatin
  Uniprot ID: O14793
  ENST ID: ENST00000260950
  CDS Start-End: 134-1261
agattcactggtgtggcaagttgtctctcagactgtacatgcattaaaattttgcttggcattactcaaaagcaaaagaaaagtaaaaggaagaaacaagaacaagaaaaaagattatattgattttaaaatcatgcaaaaactgcaactctgtgtttatatttacctgtttatgctgattgttgctggtccagtggatctaaatgagaacagtgagcaaaaagaaaatgtggaaaaagaggggctgtgtaatgcatgtacttggagacaaaacactaaatcttcaagaatagaagccattaagatacaaatcctcagtaaacttcgtctggaaacagctcctaacatcagcaaagatgttataagacaacttttacccaaagctcctccactccgggaactgattgatcagtatgatgtccagagggatgacagcagcgatggctctttggaagatgacgattatcacgctacaacggaaacaatcattaccatgcctacagagtctgattttctaatgcaagtggatggaaaacccaaatgttgcttctttaaatttagctctaaaatacaatacaataaagtagtaaaggcccaactatggatatatttgagacccgtcgagactcctacaacagtgtttgtgcaaatcctgagactcatcaaacctatgaaagacggtacaaggtatactggaatccgatctctgaaacttgacatgaacccaggcactggtatttggcagagcattgatgtgaagacagtgttgcaaaattggctcaaacaacctgaatccaacttaggcattgaaataaaagctttagatgagaatggtcatgatcttgctgtaaccttcccaggaccaggagaagatgggctgaatccgtttttagaggtcaaggtaacagacacaccaaaaagatccagaagggattttggtcttgactgtgatgagcactcaacagaatcacgatgctgtcgttaccctctaactgtggattttgaagcttttggatgggattggattatcgctcctaaaagatataaggccaattactgctctggagagtgtgaatttgtatttttacaaaaatatcctcatactcatctggtacaccaagcaaaccccagaggttcagcaggcccttgctgtactcccacaaagatgtctccaattaatatgctatattttaatggcaaagaacaaataatatatgggaaaattccagcgatggtagtagaccgctgtgggtgctcatgagatttatattaagcgttcataacttcctaaaacatggaaggttttcccctcaacaattttgaagctgtgaaattaagtaccacaggctataggcctagagtatgctacagtcacttaagcataagctacagtatgtaaactaaaagggggaatatatgcaatggttggcatttaaccatccaaacaaatcatacaagaaagttttatgatttccagagtttttgagctagaaggagatcaaattacatttatgttcctatatattacaacatcggcgaggaaatgaaagcgattctccttgagttctgatgaattaaaggagtatgctttaaagtctatttctttaaagttttgtttaatatttacagaaaaatccacatacagtattggtaaaatgcaggattgttatataccatcattcgaatcatccttaaacacttgaatttatattgtatggtagtatacttggtaagataaaattccacaaaaatagggatggtgcagcatatgcaatttccattcctattataattgacacagtacattaacaatccatgccaacggtgctaatacgataggctgaatgtctgaggctaccaggtttatcacataaaaaacattcagtaaaatagtaagtttctcttttcttcaggtgcattttcctacacctccaaatgaggaatggattttctttaatgtaagaagaatcatttttctagaggttggctttcaattctgtagcatacttggagaaactgcattatcttaaaaggcagtcaaatggtgtttgtttttatcaaaatgtcaaaataacatacttggagaagtatgtaattttgtctttggaaaattacaacactgcctttgcaacactgcagtttttatggtaaaataatagaaatgatcgactctatcaatattgtataaaaagactgaaacaatgcatttatataatatgtatacaatattgttttgtaaataagtgtctccttttttatttactttggtatatttttacactaaggacatttcaaattaagtactaaggcacaaagacatgtcatgcatcacagaaaagcaactacttatatttcagagcaaattagcagattaaatagtggtcttaaaactccatatgttaatgattagatggttatattacaatcattttatatttttttacatgattaacattcacttatggattcatgatggctgtataaagtgaatttgaaatttcaatggtttactgtcattgtgtttaaatctcaacgttccattattttaatacttgcaaaaacattactaagtataccaaaataattgactctattatctgaaatgaagaataaactgatgctatctcaacaataactgttacttttattttataatttgataatgaatatatttctgcatttatttacttctgttttgtaaattgggattttgttaatcaaatttattgtactatgactaaatgaaattatttcttacatctaatttgtagaaacagtataagttatattaaagtgttttcacatttttttgaaagacacaa

SEQ ID NO: 157061 - DNA, 2337 bp, Homo sapiens
  Payload ID: 10783
  Gene Symbol: MYOT
  Gene Name: myotilin
  ENST ID: ENST00000239926
  CDS Start-End: 375-1871
ggacaggcaagcacatcagatgtcactgtttggcagctgataaaagtcagtggtgctataatactaagcacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaaggttgcttctgattccttacaaccttccgtaattccaggcttgtggccccaaattcagggccccacccttccaggaacaaatcattatagtaataatttgccttcatcttccatataccaactaagcatgtttaactacgaacgtccaaaacacttcatccagtcccaaaacccatgtggctccagattgcagcctcctggaccagaaacctccagcttctctagccagaccaaacagtcttccattatcatccagccccgccagtgtacagagcaaagattttctgcctcctcaacactgagctctcacatcaccatgtcctcctctgctttccctgcttctccccagcagcatgctggctccaacccaggccaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttgactcttgcacattctatgtacccctccgatttgtgaagcctacaggaaatctgggtatatggatttgtaactgcagaagactatcttaaaatacaggattttaacatttaagtcatgcacatttaacaattacaggttataaattagtatcaactttttaaacacatctaatgcttgtaataacgtttactggtactgctttctaaatactgttttacccgttttctcttgtaggaatactaacatggtatagattatctgagtgttccacagttgtatgtcaaaagaaaataaaattcaaatatttaaaacgga

SEQ ID NO: 157062 - DNA, 1474 bp, Homo sapiens
  Payload ID: 10783
  Gene Symbol: MYOT
  Gene Name: myotilin
  Uniprot ID: Q9UBF9
  ENST ID: ENST00000421631
  CDS Start-End: 378-1322
gcacagagccactagattagtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagctatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattatttatcctttga

SEQ ID NO: 157063 - DNA, 1578 bp, Homo sapiens
  Payload ID: 10783
  Gene Symbol: MYOT
  Gene Name: myotilin
  ENST ID: ENST00000515645
  CDS Start-End: 284-1435
agtctgtgagggaaggagatgcctcttccttcccttcaatagtgggttaaacccagctggcaccctctggaactacgggaacaatattcttcaagagaaggtcactctaccaaagccaggagcacagtattctcaggatctcaacaaggaagagcagaccaagcatgctggctccaacccaggccaaagggttacaaccacctataaccagtccccagccagcttcctcagctccatattaccatcacagcctgattacaatagcagtaaaatcccttccgctatggattccaactatcaacagtcctcagctggccaacctataaatgcaaagccatcccaaactgcaaatgctaagcccataccaagaactcctgatcatgaaatacaaggatcaaaagaagctttgattcaagatttggaaagaaagctgaaatgcaaggacacccttcttcataatggaaatcaacgtctaacatatgaagagaagatggctcgcagattgctaggaccacagaatgcagctgctgtgtttcaagctcaggatgacagtggtgcacaagactcgcagcaacacaactcagaacatgcgcgactgcaagttcctacatcacaagtaagaagtagatcaacctcaaggggagatgtgaatgatcaggatgcaatccaggagaaattttacccaccacgtttcattcaagtgccagagaacatgtcgattgatgaaggaagattctgcagaatggacttcaaagtgagtggactgccagctcctgatgtgtcatggtatctaaatggaagaacagttcaatcagatgatttgcacaaaatgatagtgtctgagaagggtcttcattcactcatctttgaagtagtcagagcttcagatgcaggggcttatgcatgtgttgccaagaatagagcaggagaagccaccttcactgtgcagctggatgtccttgcaaaagaacataaaagagcaccaatgtttatctacaaaccacagagcaaaaaagttttagagggagattcagtgaaactagaatgccagatctcggctatacctccaccaaagcttttctggaaaagaaataatgaaatggtacaattcaacactgaccgaataagcttatatcaagataacactggaagagttactttactgataaaagatgtaaacaagaaagatgctgggtggtatactgtgtcagcagttaatgaagctggagtgactacatgtaacacaagattagacgttacggcacgtccaaaccaaactcttccagctcctaagcagttacgggttcgaccaacattcagcaaatatttagcacttaatgggaaaggtttgaatgtaaaacaagcttttaacccagaaggagaatttcagcgtttggcagctcaatctggactctatgaaagtgaagaactttaataactttaccaacattggaaaacagccaactacaccattagtaatatatttgattacatttttttgaaattaatccatagctgtattaacagattatggttttaattaggtaatatagttaatatatatttataatattattt

SEQ ID NO: 157064 - DNA, 3738 bp, Homo sapiens
  Payload ID: 10784
  Gene Symbol: MTPN
  Gene Name: myotrophin
  Uniprot ID: P58546
  ENST ID: ENST00000393085
  CDS Start-End: 217-573
ctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggagaagatgtcaaccggacactagaaggtggaaggaaacctcttcattatgcagcagattgtgggcagcttgaaatcctggaatttctgctgctgaaaggagcagatattaatgctccagataaacatcatattactcctcttctgtctgctgtctatgagggtcatgtttcctgtgtgaaattgcttctgtcaaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatacttttgacgcagttgggtttctcataagtatcctagttcatgtacatccgaatgctaaataatactgtgttttaagttttgtgttgcaagaacaaatggaataaacttgaattgtgctac

SEQ ID NO: 157065 - DNA, 879 bp, Homo sapiens
  Payload ID: 10784
  Gene Symbol: MTPN
  Gene Name: myotrophin
  ENST ID: ENST00000435723
  CDS Start-End: 254-412
aaaggttcctgcctctcctcggccaggcggaacctctctgctgggcccggtggccgcaaaagaactttctttctcccgcccgaacggtcgccgcggccaactgcctcgcccgcctggcagcctaaccctccttctcttcttctcctctccggcttcgcgcggccctgcctccctctcgcccggcggcatccgcttgctgctgccaccgcctcctcatcttctgcccggccaaccggcctgccccgctgcagtgatgtgcgacaaggagttcatgtgggccctgaaaaacggagacttggatgaggtgaaagactatgtggccaagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaa

SEQ ID NO: 157066 - DNA, 3593 bp, Homo sapiens
  Payload ID: 10785
  Gene Symbol: MTM1
  Gene Name: myotubularin 1
  Uniprot ID: Q13496
  ENST ID: ENST00000370396
  CDS Start-End: 55-1866
gcagccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacctaacactgttttcagggctgtgagtgtgcatgtgttggaaatgtgcatggtggccatctgatttctttgcccgggtctgcttcatgtactttttatctcaccggcaaccttgcagggctctcccaaaatttcagcaagattgggcatttaagtgtattaaacagtgcagattttaagagtca

SEQ ID NO: 157067 - DNA, 361 bp, Homo sapiens
  Payload ID: 10785
  Gene Symbol: MTM1
  Gene Name: myotubularin 1
  ENST ID: ENST00000424519
  CDS Start-End: 52-361
gccgagcagcctggcaacggcggtggcgcccggagcccgagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacgccattatttgcatttttaaatgaagaaaagtttaacgtggatggatggacagtttacaatccagtggaagaatacagga

SEQ ID NO: 157068 - DNA, 2755 bp, Homo sapiens
  Payload ID: 10786
  Gene Symbol: MTMR1
  Gene Name: myotubularin related protein 1
  Uniprot ID: Q13613
  ENST ID: ENST00000370390
  CDS Start-End: 158-2155
gggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgtat

SEQ ID NO: 157069 - DNA, 397 bp, Homo sapiens
  Payload ID: 10786
  Gene Symbol: MTMR1
  Gene Name: myotubularin related protein 1
  ENST ID: ENST00000438018
  CDS Start-End: 1-397
catgttgaatggtgtaaacagcttatagctgctacaatttctagtcagatttcaggttcagtgacatcagaaaatgtgtccagagattacaaggttttcaggaggcctgatctaaggaacattcataaagcaagacaaagattggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaatt

SEQ ID NO: 157070 - DNA, 564 bp, Homo sapiens
  Payload ID: 10786
  Gene Symbol: MTMR1
  Gene Name: myotubularin related protein 1
  ENST ID: ENST00000429965
  CDS Start-End: 302-564
aaaatgcacggaattgctcctgcttcaagatgtcaagaccgagggagcttgagctgttctataccttttccgggaaggacaactgagtcccacaggatcacatgttgaatggtgtaaacagcttatagctgctacaatttctagtcagatttcaggttcagtgacatcagaaaatgtgtccagagattacaaggttttcaggaggcctgatctaagggagattcaggaagaacacaatggctacccttctgaagctgaagctgatcaggtggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaactt

SEQ ID NO: 157071 - DNA, 573 bp, Homo sapiens
  Payload ID: 10786
  Gene Symbol: MTMR1
  Gene Name: myotubularin related protein 1
  ENST ID: ENST00000439546
  CDS Start-End: 304-573
ttgctaaaatgcacggaattgctcctgcttcaagatgtcaagaccgagggagcttgagctgttctataccttttccgggaaggacaactgagtcccacaggatcacatgttgaatggtgtaaacagcttatagctgctacaatttctagtcagatttcaggttcagtgacatcagaaaatgtgtccagagattacaaggttttcaggaggcctgatctaagggagattcaggaagaacacaatggctacccttctgaagctgaagctgatcaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggctt

SEQ ID NO: 157072 - DNA, 549 bp, Homo sapiens
  Payload ID: 10786
  Gene Symbol: MTMR1
  Gene Name: myotubularin related protein 1
  ENST ID: ENST00000434699
  CDS Start-End: 289-549
aagatgtcaagaccgagggagcttgagctgttctataccttttccgggaaggacaactgaggatcacatgttgaatggtgtaaacagcttatagctgctacaatttctagtcagatttcaggttcagtgacatcagaaaatgtgtccagagattacaaggttttcaggaggcctgatctaaggaatttagcaactaaaaaaaaaaaggagattcaggaagaacacaatggctacccttctgaagctgaagctgatcaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaac

SEQ ID NO: 157073 - DNA, 4516 bp, Homo sapiens
  Payload ID: 10786
  Gene Symbol: MTMR1
  Gene Name: myotubularin related protein 1
  ENST ID: ENST00000445323
  CDS Start-End: 122-2143
gcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggttttcaggaggcctgatctaagggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaacgtgttctgtcctcacctcactctggtactcgcctcttggggcggctcagcccattcatggggatggcaccaagcggccatgctcagtcttccagccccgctgagggtaaaccgaggcctctggcagctgtgcacaggtgctggcctctggctccttcaaggagcactgcctgtcactcgctcctgggctgtctagccatgtctcccacccccactttaccgcagccagctgctgggatcaaagcaagtctgttcttatgttatttgcctgtatgaaatcatttctcattttatcacaattccttcaactcagcttactcgcgtggctgcctgttcatatttgaaagcagccaccgtgctgtggctttggtttggaaaagcatagcacgcacttcccttggttttcccttcccagagccgaccgcagctggtcagccctctcttcccgctcctgaacctttacttactgactttgagctctgtgactccgtcggttctcgcaggaattaactaacttaccaattggttcaatccacttgagcgccatagctctgagctcctctgtgtgacatgccacagatgactattgcacacctgggtcctgccccagcaggccatgcccctcccatgtgccgtgcctgttgctgcagctgcccccccaccccgccactggctgcaggaattcagcctttagaggcagaggcagctgcagcggcccctgaggtcaaaccccagtgtgactgcatagcagtgttagctggttggtttcaaactactggattccaggcaaaggcctacagattgaccttattatttttgaaaatatgttaagggttttttcgtagagagagaaagaatggatttttttttaactgggaacctcctgattcttacggaaaattatccttctataagaagataccagagagatttattcaaggtaatttgataacctaaaatcaattctccattttttatcatatgtgggatttgttgctaagtcgtgttcaacaatagcttttatgttcctaacatatctgaaagcttatttatgaatggatatactggattattgatatactgattttttttttaatggggacatttgccattttcttcccagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgta

SEQ ID NO: 157074 - DNA, 448 bp, Homo sapiens
  Payload ID: 10786
  Gene Symbol: MTMR1
  Gene Name: myotubularin related protein 1
  ENST ID: ENST00000436701
  CDS Start-End: 1-448
catgttgaatggtgtaaacagcttatagctgctacaatttctagtcagatttcaggttcagtgacatcagaaaatgtgtccagagattacaaggttttcaggaggcctgatctaaggaacattcataaagcaagacaaagattggagattcaggaagaacacaatggctacccttctgaagctgaagctgatcaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaatt

SEQ ID NO: 157075 - DNA, 700 bp, Homo sapiens
  Payload ID: 10786
  Gene Symbol: MTMR1
  Gene Name: myotubularin related protein 1
  ENST ID: ENST00000493995
  CDS Start-End: 260-700
ggaggaattgctaaaatgcacggaattgctcctgcttcaagatgtcaagaccgagggagcttgagctgttctataccttttccgggaaggacaactgagtcccacaggatcacatgttgaatggtgtaaacagcttatagctgctacaatttctagtcagatttcaggttcagtgacatcagaaaatgtgtccagagattacaaggttttcaggaggcctgatctaagggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttg

SEQ ID NO: 157076 - DNA, 2973 bp, Homo sapiens
  Payload ID: 10786
  Gene Symbol: MTMR1
  Gene Name: myotubularin related protein 1
  Uniprot ID: Q13613
  ENST ID: ENST00000485376
  CDS Start-End: 166-1872
ggccttgtgggtaacgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagacaaagggtggaggatatgaaagtgaaagtgcttacccaaatgcagaacttgtgttcttggagatccacaacattcatgtcatgcgagagtcactacgcaaattaaaagagattgtgtacccttcgatcgatgaggcgcggtggctctccaatgtggatgggacgcattggctggaatatataaggatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggcatggggggctgggacccagcgagcccgtggctctctcaggagtagatgagtgctagaccctggacctcctgactccgagttcatgtagtctccgctgcaccaactccaaaaccgtgggattctgcttttcatcctctgtggtgttggccagatcatacttgaaggccttggaaatggagtctgctgattagccaaaaagcccactttaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgtttgctccctggtcttttttaagtaagtaagtaagtatcttagtagatttttcctttgaggaaaatcggtaataaaataacatggattgaatgtttactgtgcgtcaagcacagttaatatatgatgatgtaaagtaactaactttatgtgatttaattcattcagtaaattgtaaatgta

SEQ ID NO: 157077 - DNA, 1967 bp, Homo sapiens
  Payload ID: 10786
  Gene Symbol: MTMR1
  Gene Name: myotubularin related protein 1
  ENST ID: ENST00000488357
  CDS Start-End: 1-1217
caggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagatgctgcttgctggggcagtaagaattgctgataaaatagaatctgggaaaacatctgtggtggtgcattgcagcgacggttgggaccgaacagcccagctcacatctctggctatgctaatgttggacagttactacaggaccattaaaggatttgaaactctcgtagaaaaggagtggataagctttggacacaggtttgcactgcgagtgggccatggtaatgacaaccatgcggatgctgaccgatctcccatatttctgcagtttgttgattgtgtttggcaaatgacaaggcagtttccttcagcattcgagtttaatgagctattcttgattacaattttggatcacctttatagctgtctttttgggacctttttgtgcaactgtgaacagcagcgattcaaagaggcatggggggctgggacccagcgagcccgtggctctctcaggagtagatgagtgctagaccctggacctcctgactccgagttcatgtagtctccgctgcaccaactccaaaaccgtgggattctgcttttcatcctctgtggtgttggccagatcatacttgaaggccttggaaatggagtctgctgattagccaaaaagcccactttaggatgtatatacaaagacgatatctttatggtcgtatatcaatagccagctagacgagttttctaatcccttctttgtgaattatgaaaaccacgtgttatatcctgttgctagtctgagtcatttggaattgtgggtaaattattatgtacgatggaatccacggatgagacctcagaaatatgtaatcccctggctgactaggactgttaaacatagtgtggactggatgatgccttcgacaaaccagagaagccaagttggggggagctggtgcctggagtgggccctgtgcacctcacctggcggaggctggggggggctctgtcagcaggaccctagaggagactctcattcgattttaaagaagcacaacgggtcattttcctttgtatgttcctagcgcagaactgtttctaaaacaacttgaagtatagttttgttatctaagcaatttttgttttaagtaagtaagtgtactagaatgcgaagccgttatggttcaggtttttaaaaactggtacagtattgtatttgtctcatctgttgcactgtatttcaatcatctgtaattaaaatgatcatatgttt

SEQ ID NO: 157078 - DNA, 713 bp, Homo sapiens
  Payload ID: 10786
  Gene Symbol: MTMR1
  Gene Name: myotubularin related protein 1
  ENST ID: ENST00000490316
  CDS Start-End: 153-708
acgcggggccgccaggtgacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggagattcaggaagaacacaatggctacccttctgaagctgaagctgatcaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgt

SEQ ID NO: 157079 - DNA, 1227 bp, Homo sapiens
  Payload ID: 10786
  Gene Symbol: MTMR1
  Gene Name: myotubularin related protein 1
  ENST ID: ENST00000542156
  CDS Start-End: 136-1227
gacagctaatggcggcggccgcctgaggcgggcgggcggtatagagcgggcggcaggaggcaagcagcgaaaccttcccggccgccgctcccgtcccgacggcggcttccccaaggcggcaggactcggcgcgccatggacaggccggcggcggcggcggcggcgggctgcgagggcggcgggggcccgaacccggggccggcgggcggcaggaggcctcctcgggccgcggggggcgccaccgccggctcccggcagcccagcgtggagaccctggacagtcccacaggatcacatgttgaatggtgtaaacagcttatagctgctacaatttctagtcagatttcaggttcagtgacatcagaaaatgtgtccagagattacaaggctctaagggatggaaataagctggcacagatggaagaggctccacttttcccaggagaatcaattaaagccattgtgaaagatgtcatgtatatctgcccatttatgggagcagtgagtggaaccctgacagtgacggactttaagctgtacttcaaaaatgtcgagagggacccgcattttatccttgatgttccccttggagtgatcagcagagtggagaagattggagcacagagccatggagacaattcctgtggtatagagatagtgtgcaaggatatgaggaacttgcggcttgcttataaacaggaagaacagagtaaactagggatatttgaaaacctcaacaaacatgcatttcctctttctaacggacaggcactatttgcattcagctataaagaaaaatttccaattaatggctggaaagtttatgatccagtatctgaatataagagacagggcttgccaaatgagagttggaaaatatccaaaataaacagtaattatgagttctgtgacacctaccctgccatcattgttgtgccaactagtgtaaaagatgatgacctttcaaaagtggcagcttttcgagcaaaaggcagagtccctgtgttgtcatggattcatccggaaagtcaagcaacgattacccgttgcagccagccacttgtgggtcccaatgataagcgctgcaaagaggatgaaaaatacttgcaaacaataatggatgctaacgcacagtcacacaagcttatcatctttgatgctcgacaaaacagtgtcgctgataccaacaagctttggtatcaggatacagctagcctcatggaatga

SEQ ID NO: 157080 - DNA, 4961 bp, Homo sapiens
  Payload ID: 10787
  Gene Symbol: MTMR10
  Gene Name: myotubularin related protein 10
  Uniprot ID: Q9NXD2
  ENST ID: ENST00000435680
  CDS Start-End: 99-2432
agaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgagcaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcgtctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgaatgtgaaggaaattttgatggcttaataaaattccacagcgactgtt

SEQ ID NO: 157081 - DNA, 1106 bp, Homo sapiens
  Payload ID: 10787
  Gene Symbol: MTMR10
  Gene Name: myotubularin related protein 10
  ENST ID: ENST00000568547
  CDS Start-End: 1-259
gttaattatttattgtaaagatttcagaattgtcagatttcgctttgatgaatcaggtcccgaaagtgctaaaaagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggtctggctcttgtaaccgtgatcaaactgttcatgttgtctgctaca

SEQ ID NO: 157082 - DNA, 631 bp, Homo sapiens
  Payload ID: 10787
  Gene Symbol: MTMR10
  Gene Name: myotubularin related protein 10
  ENST ID: ENST00000564787
  CDS Start-End: 102-254
cgcagaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccagaaattccattacagaaaccttcttcttggtgaacacgatgtccctttaacatgtattgagcaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttg

SEQ ID NO: 157083 - DNA, 2216 bp, Homo sapiens
  Payload ID: 10787
  Gene Symbol: MTMR10
  Gene Name: myotubularin related protein 10
  Uniprot ID: Q9NXD2
  ENST ID: ENST00000563714
  CDS Start-End: 345-1700
ctcctctgcgcttccgtggagcctccaggccgacccccgggaactggaggaccccaggaggctgcgcgcgtctccctgcccacagcagcgcggctgcctgattcccggcgccgcgaaatgcgccttctcgggagcccccactggctcggcgaaaacttactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgagcaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggtcagtaggataaaaagttgtacaaaacaagattattttccttcacgagtttgaagtttctggtcacaattcattgatgtagaggatttatgactaagcagggtctcaagccaaacttgaaaccattctgaaccaaagtgccatttcacccacctcgaaccaacaacagaagctgacaaatgccgtggagaccattgagagaaacagaaaggggcagctcttgtggaccttcaggaagcctttctaggaagaggattgccctcatagtgagctccggggtcttcagcctcagccgtaaggccctgggctaggcagtgtgacctagggagcgggaaacctgagttctggccctggtctgggaaaagtgctaggcccatgttccactcaggcttcagcctgagagtccaggttgctaacctgtaaaatggatctgtcaaactaacacttatgcctttagtctcattgtatgaggtgaaacattttgtaaactgtgaatcattatgcaaattttcctaaagacatatgaattattctggatttgttggtataaaagacaaaacacactggtca

SEQ ID NO: 157084 - DNA, 2833 bp, Homo sapiens
  Payload ID: 10787
  Gene Symbol: MTMR10
  Gene Name: myotubularin related protein 10
  ENST ID: ENST00000567567
  CDS Start-End: 73-645
gagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgagcaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagaagcataaatactgcatctttaagatcaaaaggagcctgaaatttccacacactgcagtcagaattcattaatttgtgagtgaaagatgcccactcatccactcttgaacttctggatgacaccttgattcattggctggattaaagaagtcctttttgcaggcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgcta

SEQ ID NO: 157085 - DNA, 1211 bp, Homo sapiens
  Payload ID: 10787
  Gene Symbol: MTMR10
  Gene Name: myotubularin related protein 10
  ENST ID: ENST00000566981
  CDS Start-End: 1-912
gcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggataaaaagttgtacaaaacaagattattttccttcacgagtttgaagtttctggtcacaattcattgatgtagaggatttatgactaagcagggtctcaagccaaacttgaaaccattctgaaccaaagtgccatttcacccacctcgaaccaacaacagaagctgacaaatgccgtggagaccattgagagaaacagaaaggggcagctcttgtggaccttcaggaagcctttctaggaagaggattgccctcatagtgagctccggggtcttcagcctcagccgtaaggccctgggctaggcagtgtgacctagggagcgggaaacctgagttctggccctggtctgggaaaagtgctaggccca

SEQ ID NO: 157086 - DNA, 5679 bp, Homo sapiens
  Payload ID: 10787
  Gene Symbol: MTMR10
  Gene Name: myotubularin related protein 10
  Uniprot ID: Q9NXD2
  ENST ID: ENST00000568604
  CDS Start-End: 98-754
gaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgagcaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaaggtaaatcacagctaacaaaacgtgatgttggctcacacgtaaccaaacacctctttttcagaacagagagcgttaaaagtaaaggcacttccaagagtaacactgctaatgcgggtttctgaggggtcattccctttttaactcaaatgactgtatcccagctttcttcctggtgtctgaggcccacaaagtctcagtacctgagagtgggcagattgcagctttgagcctgcaagcctgatttactaaagccccatttatccatttcttgatgattcaagccgccactgtggcagggaatgccgcctggctgtgatgtagtcatggcctcctgactgctatattcttgtcctaataacattcattgtttgcctttttaataattcccaaataaattcttgggattttttttggtagaaaatttgcagactactgaaaggtacagaacaaagaatcagacatttggcctcctgactgcctctgttcagtttgccattgttcttgatagaatcggccaggtctagtgttttttctagcccgtcttagaacttatccttaagcaaattagtggataggaggtactctcatcccgcccccattcaggctgatagtaacagcctaggtagagtcaacacataaaaaagtgtaattccaggggaggaggattagaataaggacacaaaggaagggaggaaaatgttctttgaggctgaaattccattaatttttcatagtattgagtttatatttgccattgcatccttcaatctttctaaaaagggaatccccggaacataataaaatctcttctgtatagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaaaatagggtgttttctgaacattttgagggaagctgtcaacttttttcctctgaattaacattgctaacctaggcgtttgaatctctaataactttatatgtaagaataatagttggaatttgcactaatatttaaaaacatgttgaatcatgcttctttcacacttattttaagagagatgtaaattttgttcctgtcctctttctgtcattacaggtctggctcttgtaaccgtgatcaaactgttcatgttgtctgctacatttttgtctccatccatttttcctaccacctcctgaaggctatctgatagtcagtcacattagcagccccaggcagcagacaacaggaaagttaggaaatttgtgtttcgtgtcatttttaggagcatctgataaaacctccagcaggttttaggaagtattcatgtatttttctggttactttctgtcgtctctaattgaactcacctgatgaaggttcagtgttctggggccagaatttatgattttagatcaccttctttggaaccttagatcactgtgttttgaaatcatgagtttgcttttaacttcatagggtcaactttaaaatgatatgcactgttaattttaaagcatttgctgcagataattaaacttagaagtgcctttgactttaggatacaaatattacagaagaaaatataatttcactttttaaaattggggtgggaaaatcccattgcatatttgaaataggcttttcatactaagcttcatagccaggagtccccagagtcttgttcctctgaaagccactggggagtggcctctggggtgctgattccacagaggtgtatgctgtagacaggagagtgccatctatgccaaaactcgccctcaaaaacaaacaaggcttgctgggaggcgtgctgggcttggccatcagtatttccagtgtggtaaactattgctggcacttccccctggaaataactaatgaggttacgagttgggcacctgcacagatgtccttctctcatagttcctaatgcttaggaatagaggagaaataaaaaaatggattctctcaaaacactgccatttgaatagcgacagaagtgctcccccagcccccaactttggacagcaaagttgaggagaatgagcagacacagttgtttgcttgatctgaatctctctaaagtaaagtatttccaaactgtgtgacaagagcctacctaccactgtagcggtcaaagctgaagcttcttacagcagtgaaacggggcaccacctcccccacactcctcattccccgcttaaaacatggatactttcaaatttgactgtttcttaaactgccatcctaagatatggaaaatttttatagtaaagtgtctagttagcttatttccttttctaaaacaagtgttttcaagataactgtattttacctttatatgtactgaatagctgtttctttttgaattatttgccttttaaaatttgataatgtctctggatataacaggacaggagttcttaaaaaatatcttaagaaattcactttatgggtaaacccaaggtttttgccaacttgttgcctagaaaataagggctagtttcagtttatacaaatagaattattaaacattttacagtccttgattagaaaccagacccaatctccttataacaccacagcgtatcctgccattgacagtgtaatcacaattctccctttttcatttagctgcttttttattattactaaatgttttggattgagcatttttccctctgtaattttcttccttcacgtttattttaactcttgtagtattttattgttgttaatttacaagtttaaaaatattaggtactattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtacagtgtcttgctgttattttatgatggaaactgattttgaaaccaaaaatagctaactaactttatttaaggaaaggatattaatttgtactaacagagggtgaaagctgttcacatttgtcaacaaaatctgcttgctgcagtagtaacctcaagtggttaaaacttgatttcccgagaaaactaaaacctttgtgcctaaaattgatgacttgagttcaagtgggatgagcaagaagatgtgttatcttgttgttcaacagtattgaatgtgaaggaaattttgatggcttaataaaattccacagc

SEQ ID NO: 157087 - DNA, 2334 bp, Homo sapiens
  Payload ID: 10787
  Gene Symbol: MTMR10
  Gene Name: myotubularin related protein 10
  Uniprot ID: Q9NXD2
  ENST ID: ENST00000621195
  CDS Start-End: 1-2334
atgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaaaatgcattgcaacagacacaagccagtacgatttgtggggaaagctgatatgcagtaacttcaaaatctcctttattacagatgacccaatgccattacagaaattccattacagaaaccttcttcttggtgaacacgatgtccctttaacatgtattgagcaaattgtcacagtaaacgaccacaagaggaagcagaaagtcctaggccccaaccagaaactgaaatttaatccaacagagttaattatttattgtaaagatttcagaattgtcagatttcgctttgatgaatcaggtcccgaaagtgctaaaaaggtatgccttgcaatagctcattattcccagccaacagacctccagctactctttgcatttgaatatgttgggaaaaaataccacaattcagcaaacaaaattaatggaattccctcaggagatggaggaggaggaggaggaggaggtaatggagctggtggtggcagcagccagaaaactccactctttgaaacttactcggattgggacagagaaatcaagaggacaggtgcttccgggtggagagtttgttctattaacgagggttacatgatatccacttgccttccagaatacattgtagtgccaagttctttagcagaccaagatctaaagatcttttcccattcttttgttgggagaaggatgccactctggtgctggagccactctaacggcagtgctcttgtgcgaatggccctcatcaaagacgtgctgcagcagaggaagattgaccagaggatttgtaatgcaataactaaaagtcacccacagagaagtgatgtttacaaatcagatttggataagaccttgcctaatattcaagaagtacaggcagcatttgtaaaactgaagcagctatgcgttaatgagccttttgaagaaactgaagagaaatggttatcttcactggaaaatactcgatggttagaatatgtaagggcattccttaagcattcagcagaacttgtatacatgctagaaagcaaacatctctctgtagtcctacaagaggaggaaggaagagacttgagctgttgtgtagcttctcttgttcaagtgatgctggatccctattttaggacaattactggatttcagagtctgatacagaaggagtgggtcatggcaggatatcagtttctagacagatgcaaccatctaaagagatcagagaaagagtctcctttatttttgctattcttggatgccacctggcagctgttagaacaatatcctgcagcttttgagttctccgaaacctacctggcagtgttgtatgacagcacccggatctcactgtttggcaccttcctgttcaactcccctcaccagcgagtgaagcaaagcacggaatttgctataagcaaaaacatccaattgggtgatgagaagggcttaaaattcccctctgtttgggactggtctctccagtttacagcaaaggatcgcacccttttccataaccccttctacattggaaagagcacaccttgtatacagaatggctccgtgaagtcttttaaacggacaaagaaaagctacagctccacactaagaggaatgccgtctgccttaaagaatggaatcatcagtgaccaagaattacttccaaggagaaattcattgatattaaaaccaaagccagatccagctcagcaaaccgacagccagaacagtgatacggagcagtattttagagaatggttttccaaacccgccaacctgcacggtgttattctgccacgtgtctctggaacacacataaaactgtggaaactgtgctacttccgctgggttcccgaggcccagatcagcctgggtggctccatcacagcctttcacaagctctccctcctggctgatgaagtcgacgtactgagcaggatgctgcggcaacagcgcagtggccccctggaggcctgctatggggagctgggccagagcaggatgtacttcaacgccagcggccctcaccacaccgacacctcggggacaccggagtttctctcctcctcatttccattttctcctgtagggaatctgtgcagacgaagcattttaggaacaccattaagcaaatttttaagtggggccaaaatatggttgtctactgagacattagcaaatgaagactaa

SEQ ID NO: 157088 - DNA, 150 bp, Homo sapiens
  Payload ID: 10787
  Gene Symbol: MTMR10
  Gene Name: myotubularin related protein 10
  ENST ID: ENST00000628420
  CDS Start-End: 1-150
atgttctccctcaagccgcccaaacccaccttcaggtcctacctcctgccaccgccccagactgacgataagatcaattcggaaccgaagattaaaaaactggagccagtccttttgccagaaattccattacagaaaccttcttcttgg

SEQ ID NO: 157089 - DNA, 2324 bp, Homo sapiens
  Payload ID: 10788
  Gene Symbol: MTMR11
  Gene Name: myotubularin related protein 11
  Uniprot ID: A4FU01
  ENST ID: ENST00000369140
  CDS Start-End: 187-2109
acagacactgatctcagtttcccccgagagtgtgagtgtaggcctctacaggcagctgcctctggggagttggggagcctaggggttaactctagacccccctcaaccctctggaccaaagtctgtccaggaaaataggatgccggagcccaggagtcgtcagcctagcagttgcctggcctccagatgcctcccagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatacac

SEQ ID NO: 157090 - DNA, 2856 bp, Homo sapiens
  Payload ID: 10788
  Gene Symbol: MTMR11
  Gene Name: myotubularin related protein 11
  Uniprot ID: A4FU01
  ENST ID: ENST00000439741
  CDS Start-End: 252-2381
catctctcccgccctctccagagtcgactgaagtttccgaggagacttctcaggctgggctggacacacctttccaaggacccccaaactctgctccgtgcacgtcaaatgctcctttcccttgtgtccaaccccctacccctctccctaacacccctcttctcaacaagactcagcctctccccgaggtgggtgagcatccttgaggtttcccacccttaactgctgtgtccccggatggagccagagaaatgtggtgggggggccggggccagagtttcaacattgccccccagaaggaggagccagagatggggtctgtccaggaaaataggatgccggagcccaggagtcgtcagcctagcagttgcctggcctccagatgcctcccaggggagcagatcctagcatgggccccaggggtgaggaagggcctggaaccagaattgtctggaaccctgatctgtaccaactttagggtcaccttccagccctgtggatggcagtggaatcaggacactcccttgaacagtgaatacgattttgccctggtcaacattggacgattagaggctgtgagcggcttgtcccgagtccagctcctccgtccagggtccctgcataaatttatccctgaggagattctgattcatggccgagacttccggctgctcagagttggttttgaggctggaggcctagagcctcaggcttttcaggtgaccatggccattgtccaagccagagctcagagcaatcaagcccaacagtattcggggataaccctgagcaaggctggccagggttctggctccagaaaaccaccaattcctctcatggagacagcggaagactgggagactgagcggaagaagcaggcagccagaggctggagggtcagcacggtcaacgagaggttcgacgtagccaccagcctcccccgttacttctgggtccctaaccgaattctggacagtgaggtcaggagagcatttggccactttcatcagggccgtggaccgcgcttgtcctggcatcaccctgggggcagtgatcttctccgctgtggaggcttctatacagccagtgaccctaacaaggaggatatcagagcagtggagttgatgctccaggctgggcattcagatgttgtcctggtagacactatggatgagctgcccagccttgcagatgtccaacttgcccacctgaggctgagggccctctgcctgcctgattcatctgtagctgaggataaatggctttcagccctggaaggaacacgatggctggactatgtcagggcttgtcttcgaaaggccagtgacatttcagtattagtgacatccagggttcgttctgtaatacttcaagagcgcggtgatcgtgatctcaatggcctcctctcttcactcgtccagctgctttcagcccccgaagcccgaacactgtttggcttccaatcactagtacagcgagagtgggtggcagctggacatcccttcctgactcggcttgggggaactggggccagtgaagaggctccggtgtttctcctcttccttgattgtgtctggcagctcctccagcagtttccagctgattttgaattctctgagtttttccttcttgctcttcatgacagtgtcagggttcctgacacccttaccttcctgagaaataccccctgggagcgcggaaagcagagcggacagttaaactcctatacacaagtctacaccccaggatactcccagcctccagctgggaactcttttaacctgcagctgtctgtctgggactgggatttacgttatagcaatgcacagatactacaattccagaatcctggctatgacccagaacactgtccagattcctggctccctagaccacagccaagcttcatggttcctggaccccccagttctgtgtggctcttctctagaggagcattgacccccctgaatcagctctgtccttggcgggacagtccttccctgctggcagtctcttctcgttggctccctcgacctgctatctcctctgaaagcctggctgaccaggaatggggtctcccctcacattggggagcttgccctttacctccagggctgctgctgcctgggtatctgggaccccagatcaggctctggagacgctgctacctgaggggaaggcctgaggtccagatgggcctctcagctcccacaatctctggcctccaggatgagctatcccatcttcaggagttattacggaaatggacaccaagaatatctcctgaggatcactccaagaaaagagatccacataccattctcaatcccactgaaattgctggcattctcaaaggcagggcagagggggatctggggtagaggagggttctgtctaatcttttttttttttttttgtatctgcacttgcagcctcagctttcacacttcagcccttaagttcactaagaaggtctgagtttctgctgcagatagtggtgttaactgctccaactcttgtcttgcttagtttctacaaatatttttgcttcttgtcatttgaaggattaagaaacaaaaacaatccagaaattgatcggtttttttaggccaatcccatcccttctggataaccagatgttaaatcatgagatcagagatgctgttcatcagtcccaacaagatggcctagaaatcgcattctcacctcgccttgctgctgctttaattccaagttctatttcttcccttatagttttctatgggaatgaggcggatacaggaaacaccctatctcctctgtatttttgtagtggaatttctatttaaggggctcattaaagcatagtatttatac

SEQ ID NO: 157091 - DNA, 2215 bp, Homo sapiens
  Payload ID: 10789
  Gene Symbol: MTMR12
  Gene Name: myotubularin related protein 12
  Uniprot ID: Q9C0I1
  ENST ID: ENST00000264934
  CDS Start-End: 132-2045
atcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggagcatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattcta

SEQ ID NO: 157092 - DNA, 4966 bp, Homo sapiens
  Payload ID: 10789
  Gene Symbol: MTMR12
  Gene Name: myotubularin related protein 12
  Uniprot ID: Q9C0I1
  ENST ID: ENST00000280285
  CDS Start-End: 101-2182
gagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgcatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattactaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaatactgtacttggt

SEQ ID NO: 157093 - DNA, 5187 bp, Homo sapiens
  Payload ID: 10789
  Gene Symbol: MTMR12
  Gene Name: myotubularin related protein 12
  Uniprot ID: Q9C0I1
  ENST ID: ENST00000382142
  CDS Start-End: 172-2415
ggggcgagcggtgtcagcggcggagccggatgcgggcggcatcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacagtcactgatcccaagaaccataccgtaatgtttgacacacttaaggactggtgttgggaactggaacggaccaaaggcaacatgaagtacaaagcagtgagtgtcaacgaaggctataaagtctgtgagagattgccagcatactttgttgtccccacccctcttcctgaagagaatgtgcagcgctttcagggtcatggcataccaatatggtgttggtcctgccacaatggaagtgcccttttgaaaatgtcagcactgcccaaagaacaggatgacggcattttacaaatccaaaagagcttcttagatggaatttacaagaccatccacaggccaccctatgaaattgttaaaacggaagacctgtcaagcaacttcctgtccctgcaggaaatccagactgcatactctaaatttaaacagctatttctgatagataacagtactgaattttgggacacagatataaaatggttttctctgttggaaagtagcagctggcttgacataatcagacgttgcctgaaaaaagcaatagagattacagaatgtatggaagcacaaaacatgaatgttcttcttttagaggagaatgcatccgacctctgctgtctcatttcctctctggtgcaactgatgatggacccccactgcagaaccagaattggtttccagagcctcatccaaaaggagtgggtcatgggtggccactgtttcttggatcgctgcaaccatctccgccagaacgacaaagaggaggttcctgtgttcctgcttttcctagattgtgtctggcagctggtgcaccagcatcccccggcatttgaattcacagagacttacctgactgttttgtcagatagcctgtatatacctatttttagcaccttcttcttcaattcacctcatcaaaaagatactaacatgggtagagaaggccaggatacacaaagcaagcctttgaatctgctcaccgtgtgggattggtcggtgcagtttgaacccaaagcccagacattgctcaaaaaccctctttatgtggaaaagccaaaactggacaaaggccaacggaaaggaatgcgcttcaaacatcaacgacaactttctttgccacttacacaatctaagtcatctcccaaaagaggatttttcagggaagaaacagatcatttaattaaaaaccttctgggcaagagaattagcaaacttattaattcttctgatgagctccaagacaactttcgagagttctatgacagctggcatagcaagtccactgactaccatggtttgttgttaccgcatatcgaggggcccgaaatcaaagtctgggcccagcgctacctacgttggattccagaagcccaaatcctaggtggtggccaagtggccactctgagcaaactcttggaaatgatggaggaagtccagagtttacaagagaagatcgacgagagacaccacagccagcaggccccccaggctgaggccccctgcctgctgaggaactctgcccgcctctcgtctttgtttcctttcgctctgctccagcgacattcctctaagcccgtcttacccaccagtggctggaaagctttgggagatgaagacgatttggccaaacgagaagatgagttcgtggacctaggggatgtgtgacctgtttgttgagtgattgtgaaagaggaatgtgggagattgggacagctgatccctggatttgtgtcacgctacagctcatgctggctgggtccttagcccggcactccgttagaataaacctgggccttcgggaaaagaggtggctctcattatttttcatgattctaaaagactatgcaattaaaaccgcatctgtagtattactaattggaaggaattattacttgacccgtaatagggttgtggccgttttctgatgcctaagtattatacagagcccacaatggccagtttactaccagaaagggcttcagtaagatattcttggacttgatactttcttcagatcctctttgtgccaagataatttatccagtcattgggaatagtaagtttctgtgtaacccatctcaattatagaagcaagttcagctttatgtatttgtatggggagttgaagattcagatagaggtattaagatgtgtggcatttacttaaaccatcacatttttttctttctacgcccccttgcctgtaaaacacctgggaagttccactggtgtcatccatcctgatgcttcagaccaccctcccttcttcacagaccgtgtcactttgcctgtgggtgggggctagccagccaccaccctcttttctgtgctgccagccccaggtcttcctccgcctgctccacaccactcgccgctgtccctctgcactccctgccttggtgcgtgtagtcccagtgtctcactgccaaacctcttggttacgctgcggggatctgtttctttgcctgagatccttcctgaggagcgtccattcctctggagtctctccttgtttggaacaaatcgcttcgcctttttctacttgcctgctgaagctttggagcacttgtgattgcagttttctgccgcaacccctgagccgagttcctcacattcttttacctttatggactgatgggattgggtcacttttgaatgtggctttcataggaaagcagcttaaacataaatatcagaagtgatgattatcatatgatacctcagtgattttaaaagccatagaagaaacttgactatgcctggtcaccttcttggatctgctgtctaaatgatatatatatgatatatatgtgatatatatatatcatatatatgatatatatatatatatcacatatatatgatatatatatgatatatatatatcacatatatatgatatatatatcatatatatgatatatattttttttaatgcaggaaagtatactttgtaaggagcagatttttttgttctcagtggaaccctgtcaaatcgcataaaagaggaaaaaaacaaaactcattagaatgttttaaattgaatgttcgccttttacatatatttgctcttcagtatggatcccaatttgaatgttacatgttcggaaaaactttcagttgctcaagggcaataagaaaatttgaggccgggtgtggtggctcacgcctgtaatcccagcactttgggaggctcaggtgggcgaattgcttgagcccaggagttcgagaccagccggggcaacatggcaaaaccctgtctctactaaaaatacaaaaattagctgggtgtggtggtgcatgcctgtagtcccagctactcgggaggctgaggtgggaggatcccgtgagcctgggaggtggagtttgcagtgagctaagatcgtgccactgcactccggcctgggtgatggagcaagacctcgtctcagaaaattggaaactattgactaagagaagtttctaggtttgcactgaattgtcttttgtacatacagtgaattgttttgctgttctccccactccatattaatgcaggagccaggttggtctgttaggatgaacaaaggttgaggggagggcaggattcgtgcatctgggggccaaacacatgttccgtcttgattgccttaagagttactagcgaggtcagtgttaggcttgcaatagggattttaaaatacactaactagttccttagctaccttcacatacattctataggccttcttaaattagcactaacctccacttccttctctgccccattgcctcccaaatatgctatggagctatttttgttaccacgttataacgtgaatatttatacagtagcctcttcaggctttgtaattttcattccaaaaatgcccggtgtgatgctttacactctacaaagtatggtttaaaggcacaaggtcatggcctttgtcatagcagttgaatgtgcattgacatatttttctatgattttttaaaattacaatagaaaaataagctgttgtaacgtgtaaggtcatgacaatttttgtatttatatttgaaatcagatttctataactcgtatttgtgtacagaattctcaatggatttatatattgtgaaatttttatctgagattgggatgtggattatgcttaacagtgagagctgaaatgagaccatttactttgtttaaaatgctgtactgtgcaagtttggaaatgtaaattaatttactgtatataatatcttgagtttgtttatacctccaagtttttacactgaagataaactagctttaattcaaaactttttttttctttataagggaataagctgttgagctaaacctgtatacttgtgctttttattttctggatgcacaatgaaagtttatacttgtatctcactgcatcatatctgattgcagaaattaaagcacaatttacaagcaat

SEQ ID NO: 157094 - DNA, 671 bp, Homo sapiens
  Payload ID: 10789
  Gene Symbol: MTMR12
  Gene Name: myotubularin related protein 12
  ENST ID: ENST00000505419
  CDS Start-End: 150-266
gagccggatgcgggcggcatcgcggcggtcgcggccttggggatgggcggagccccagccgctagtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggagtgtttgatgagaaaaagaaaactctctttggacaactgaagaaataccctgagaagctcatcatccactgcaaagaccttcgagtgttccagttttgtctgaggtacacaaaggaagaggaagtcaaaaggattgtcagtggcataattcatcatacccaggctcctaaactgcttaaacgattatttctgttttcctatgcgactgctgcacaaaacaatacag

SEQ ID NO: 157095 - DNA, 561 bp, Homo sapiens
  Payload ID: 10789
  Gene Symbol: MTMR12
  Gene Name: myotubularin related protein 12
  ENST ID: ENST00000513622
  CDS Start-End: 87-206
agtgctggtggccgccgctgctgccccagctggagcccgagccgccgcctctgcgtccgcgcgtcgctgcttcccagggcggcggtatgctggggaaaggagtagtcggcggtggcggcggcaccaaggcccccaagccctccttcgtgtcgtacgtacgccctgaggtcttgctctgttgcccagactggaatgcagtggtgtgatctcagctcactccagcctcaacctcctgggctgaagcaatcttcctgccttagcctcccaagtagctgggactacaggaaattcacacaaacgaaaaggaagtaacagagaaggaagtaactcttcacttgttgccaggtgaacagctgctttgtgaagccagcacagtactgaagtatgtccaggaagattcctgtcagcatggggtctatgggaggcttgtctgcacagacttcaagattgccttcttgggtgatgatgaatctgcattggataatgatgaaactcaatttaagaataaggttataggagaaaatgacattacactccactgtgttgatcagatttatggag

SEQ ID NO: 157096 - DNA, 2494 bp, Homo sapiens
  Payload ID: 10790
  Gene Symbol: MTMR14
  Gene Name: myotubularin related protein 14
  Uniprot ID: Q8NCE2
  ENST ID: ENST00000296003
  CDS Start-End: 123-2075
aagtggaagtggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcc

SEQ ID NO: 157097 - DNA, 2368 bp, Homo sapiens
  Payload ID: 10790
  Gene Symbol: MTMR14
  Gene Name: myotubularin related protein 14
  Uniprot ID: Q8NCE2
  ENST ID: ENST00000353332
  CDS Start-End: 152-1948
aaacatccggcgggacggggcggggccggaagtggaagtggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccaggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagcca

SEQ ID NO: 157098 - DNA, 2105 bp, Homo sapiens
  Payload ID: 10790
  Gene Symbol: MTMR14
  Gene Name: myotubularin related protein 14
  Uniprot ID: Q8NCE2
  ENST ID: ENST00000351233
  CDS Start-End: 73-1689
agtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaata

SEQ ID NO: 157099 - DNA, 553 bp, Homo sapiens
  Payload ID: 10790
  Gene Symbol: MTMR14
  Gene Name: myotubularin related protein 14
  ENST ID: ENST00000431250
  CDS Start-End: 92-553
agaagtattctgggatcgtttctttcagcacaccaaaatagatggtcccaaattctgcagcacaaatctaatttgtttcctccttgagtgaatggcacttctcatcctgcttttggtccctctcctcttgcctgacagtggttccgaagcctattcaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcgg

SEQ ID NO: 157100 - DNA, 1451 bp, Homo sapiens
  Payload ID: 10790
  Gene Symbol: MTMR14
  Gene Name: myotubularin related protein 14
  ENST ID: ENST00000430020
  CDS Start-End: 80-646
aggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatggtgagtctgtctcctccagagccctcgagccactgcacccttggggagttcccagttcattctgcctcaactgtatgtttgttggagttgcacaccttacttttgtgctgtgggagaggaatttggggagttcctagaatcccagaggctgggtgggatttgtccattggtggctttattccatgtcctcaaaatcctagaaaacaaaattaagaactccttaccatctatgccgtgcacagggtattttcacactgtctcagcattgcacaacagcattgtgtgtggggccaggatgggcctctcattcagaaagatgaggcatgagatgagagaatcaatccgggctgctcagtggatgcacacagcctgtagaggccctgttctccagagtcctccacccagtttggctgttttgattggatgggcctggcttgctcaatgtctctagggcagacggactctaaatccctggtagcaatca

SEQ ID NO: 157101 - DNA, 1746 bp, Homo sapiens
  Payload ID: 10790
  Gene Symbol: MTMR14
  Gene Name: myotubularin related protein 14
  ENST ID: ENST00000414996
  CDS Start-End: 20-202
gctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttgatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaa

SEQ ID NO: 157102 - DNA, 1427 bp, Homo sapiens
  Payload ID: 10790
  Gene Symbol: MTMR14
  Gene Name: myotubularin related protein 14
  ENST ID: ENST00000420925
  CDS Start-End: 135-1013
gggcggggccggaagtggaagtggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttggcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaa

SEQ ID NO: 157103 - DNA, 718 bp, Homo sapiens
  Payload ID: 10790
  Gene Symbol: MTMR14
  Gene Name: myotubularin related protein 14
  ENST ID: ENST00000437997
  CDS Start-End: 66-281
gagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaagtcgtcttatcgccagacctggagggcttcctgtcagctcaggccatccccaccctaagcactggctggcagtgcggtgggaatcttgccgaccctgccatctcattcccccacgtggttttggcagctttagcaccaagttttccagtggaattctgttccatcctgcaccacagaactctgatttgacctcagagattaccgttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggg

SEQ ID NO: 157104 - DNA, 1664 bp, Homo sapiens
  Payload ID: 10790
  Gene Symbol: MTMR14
  Gene Name: myotubularin related protein 14
  ENST ID: ENST00000447144
  CDS Start-End: 112-675
gaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatgaggccgtggagctggtcccagcaggagcgccaactcaggcagcttgatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctg

SEQ ID NO: 157105 - DNA, 773 bp, Homo sapiens
  Payload ID: 10790
  Gene Symbol: MTMR14
  Gene Name: myotubularin related protein 14
  ENST ID: ENST00000449543
  CDS Start-End: 97-207
tatagacggggtttcaccatgttggccaggctggtctttacctcctgacctcaggtgatctgccgcctgagcctccccaagtgtgggattacaggcatgagccactgtgcctggccagaaactgaattggagcttgatgtaggggaaccggtaaaggaaccactggccgacctaacaagaaaaggtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcag

SEQ ID NO: 157106 - DNA, 840 bp, Homo sapiens
  Payload ID: 10790
  Gene Symbol: MTMR14
  Gene Name: myotubularin related protein 14
  ENST ID: ENST00000416864
  CDS Start-End: 70-546
gtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagc

SEQ ID NO: 157107 - DNA, 2523 bp, Homo sapiens
  Payload ID: 10790
  Gene Symbol: MTMR14
  Gene Name: myotubularin related protein 14
  ENST ID: ENST00000617504
  CDS Start-End: 152-1714
aaacatccggcgggacggggcggggccggaagtggaagtggaagtagaaggcggtggctgaggcggttccggaggttctagtgtcggagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaaggttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaagcacatttgcaggtcggccacactggctggatggggagagctgtatggacgctcaggctacaactattttttctcagggggtgcagatgatgcctgggcagatgtggaggacgtcacggaggaggactgtgctcttcgaagtggtgacacgcatctttttgataaggtcagaggctatgacatcaagctgcttcgatacctgtcagtcaaatacatctgtgacctgatggtggagaacaagaaggtgaagtttggcatgaatgtaacctcctctgagaaggtggacaaagcccagcgctatgccgacttcactctcctctccatcccgtatccaggctgtgaatttttcaaggaatataaagatcgggattacatggcagaagggctcatatttaactggaagcaggactacgttgatgccccattgagcatccccgacttcctgactcactctctgaacattgactggagccagtatcagtgttgggatctggtgcaacaaacacaaaactacctgaagctgctgctttccttagttaacagtgatgatgacagcgggctgctggtacactgtatctcaggctgggatcggacccccctcttcatctccctcctgcgcctttccttgtgggctgatgggctcatccacacgtccctgaagcccactgagatcctctacctcactgtggcctatgactggttcctcttcgggcacatgttggtagatcggctcagcaaaggggaggagattttcttcttctgcttcaattttttgaagcatattacctccgaggagttctctgctctgaagacccagaggaggaagagtttgccagcccgggatggaggcttcaccctggaagacatctgcatgctgagacgaaaggaccgtggcagcaccaccagccttggcagcgacttctccctggtcatggagagttccccaggagccactgggagcttcacctatggccgtggagctggtcccagcaggagcgccaactcaggcagcttggaggaagagccactcatcctctccacagagtgtcctctggaaccggccacaaccctcagaggaccgcttgccttcccagcaggggctggcggaagccaggtcttccagctcctcttcctcaaaccattctgataactttttcaggatgggtagcagtcccctggaggtccccaaacccagatcagtggaccatcccctgcccggatcctctctctccacagactatggcagctggcagatggtaacgggctgtggcagtattcaggagcgggctgtcctgcacacagactcctctctccctttcagcttcccggatgagctccctaacagttgtctgcttgcagccctgagtgatcgagagactcggctgcaggaggtgcgctcagccttcttggctgcgtacagcagcacagtggggcttcgggcagtagcccccagtccttccggtgccatcgggggcctgctggagcaatttgcccgtggtgttggactccggagcatcagcagcaatgccttgtgaagaagccagcccatgacattttcctgctcctctctcagctgagcccttagcagagaatcaaagccatgcctggccgaaggggtacttccaggtcaggggaaatttcagtcccccatctccatcatgaacatggcagccccaaagctgagcaaggccaaagacagggttttccaacccccagcctcttgactggtgaccaccaccccttcttgtcactgtctcccacccaccccatctttgctgggattcccatcaactctcagaactgtgtggggtttccctggggccttgtggaagccatgacttcacaaagaccctacctgtcagttcttgtttctggggaggagggatcacctgcactgagaatgaggcagtttgacacagatcacaaaataaaatcaaagtctttttgaatagccac

SEQ ID NO: 157108 - DNA, 3350 bp, Homo sapiens
  Payload ID: 10791
  Gene Symbol: MTMR2
  Gene Name: myotubularin related protein 2
  Uniprot ID: Q13614
  ENST ID: ENST00000352297
  CDS Start-End: 434-2149
gggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactt

SEQ ID NO: 157109 - DNA, 4681 bp, Homo sapiens
  Payload ID: 10791
  Gene Symbol: MTMR2
  Gene Name: myotubularin related protein 2
  Uniprot ID: Q13614
  ENST ID: ENST00000346299
  CDS Start-End: 342-2273
ctccttccataagggtctggtccttcatccctcccgcttcaccagaccccctcaccctgggagccgccacctccctttccccaagaccagatgtcgcgcggccggacacagccagcacggagagtcgatgccggcgtctgagctgcgcagtggggtcttcccgctgcccagcagcctacaggcgcggtgcactctgggggaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccagtgcctccacttctcattcagagaattcagtgcatacaaaatcagcttctgttgtatcatcagattccatttcaacttctgccgacaacttttctcctgatttgagggtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaactttgttcttgtccaaagttgccatttcttttttttccccagaaatatttggaaattattggaggaatatgcaccccagatgaaaatgttcagtttgtacccatttttccttaaccaacacccaaatcaaacaattaaaatatacagtgtttttccactcactaattcactatacagagagtctgaaccttagcctccctcttggtcttgcagtgaggaagtttctattagtatatccaatttagcaaaattggtaccaaaatgatttctttggtaattgtgtgaaatataagctttttaacagggcatttaagtggctagcaaatcagtaattaaaaattaagctttctactccaagtatttcacaaacgcatctgccattttcctcatttaaaccttggttatcttggcctgataccacataaaagaatgtagaatggctgaagagatcaagaatttaaagcttctagtcttaacatacttgcatccacttcaaattcaaatcaaaagccagggaaatctaagtgcaaccctaccacttctctgctgagaaccttccagtggttcccctcaccttctgcagaagtctccaatatggagtacatgcacttgggcatttaatatataccactggtgtgtgtgggagggagggaggaggaatactagccctttttatatatttacacaagcaaaacttttaaatatttgaattgacagttacatgtttcataactttgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccactttggttcagtctgtcttgtgcacctggaacaactgttctcccttgtgactaattcctattttctagagtttaggcatcatctcttcctttgggaagttatctgattcacgactgccttctctgacatccccaccttcctctgtgcccccatagcactgtgtataccgctactaccactgcaattcacattatattggaatgaacaattcacatgtctaccacaagtctgtaaacataaccttatttgaaatgaattgcaataaagctctgttacaacgt

SEQ ID NO: 157110 - DNA, 4681 bp, Homo sapiens; identical to SEQ ID NO: 157109
  Payload ID: 10791
  Gene Symbol: MTMR2
  Gene Name: myotubularin related protein 2
  Uniprot ID: Q13614
  ENST ID: ENST00000393223
  CDS Start-End: 558-2273

SEQ ID NO: 157111 - DNA, 3420 bp, Homo sapiens
  Payload ID: 10791
  Gene Symbol: MTMR2
  Gene Name: myotubularin related protein 2
  Uniprot ID: Q13614
  ENST ID: ENST00000409459
  CDS Start-End: 503-2218
gaacatggccgcttccggtctccctcccgggccggcgctggcctgactgcggccccggtccgtagcactccgccctccgcttctcccgccctgtagccgcgaagactgcttcagcctttccctgtgctgcccctgccgcgcgatggagaagagctcgagctgcgagagtcttggctcccagccggcggcggctcggccgcccagcgtggactccttgtccagttaatgtgttaagagccattgacatttgaagatcatcagaagtgaagataaaacatctcaaaaattataattgcctccacttctcattcagagaattcagtgcatacaaaatcagcttctgttgtatcatcagattccatttcaacttctgccgacaacttttctcctgatttgaggcccatgcagtccagttcgggagctaagtcacttaaacactgtgtgatagttcctacacatctcattatagtttgtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagccagctctcctgcacagtgtgtcactcctgtccaaactgttgtataaaggactgtaagatcaggggcatcattgctatacactcttgattacactggcagctctatgagtagaaagtcttcggaatttagaacccatctatgagagaaagttcagtcactttatttattttaaatctctctaggatgagtttagaactgtagcagtgcaggtggcttaagtgaagtaactccatatgtaattacatgattatgatactaatcttttaagtatccaaagaatattaaaatacttcaatcctggattcacagtgggaacaagtttctattaaaaggcaaatgctgttacaaatttttggcatctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtgttgaagatactacggtgtggtagtagttgaaaattattgccgtcattatttacatacttaagacatattagcaagttgatccaaaatgggaggccttatagatgtgcttgggggaaaatgaaggggagaaagtagccatacaggagttcaaagaattccatgcccttcagattagcccaattaccagaaacatcatgaaagatattttaaaaactaattatttactacagtgtatttcacttgtcttgtgtgtctgaacacacagaagctaattagcaagtttttaagaagtatttaaaaatcttactaggattgacattttttctgaattctgtataaatagcttatagtgagaagtactgtgctcaaattttacatttttttcctttgcaaattctgtaatttcactcaacgattaagtctaccaaagaacacactgcatgtaaaagatgtattacaatctcaaagccagtaaaagaaatcttgcttcactgttcacctgctacaagtaagagtttggtgctggtagaaacatttgactctgatgtctattttattctacataagagccatatgtaatgtactgtaacaaaggagcttcttgtccccttggtcttttaattaaaagaaattccaactgacttttaaacttt

SEQ ID NO: 157112 - DNA, 2018 bp, Homo sapiens
  Payload ID: 10791
  Gene Symbol: MTMR2
  Gene Name: myotubularin related protein 2
  ENST ID: ENST00000444541
  CDS Start-End: 349-2018
attctggttttgaaatcattggatagacttggtgaaggaaagaaaaaacttttttttgtatccatgatattatttctacctggatttaagtttcatgcttacgaaaatgaggatctgatttcattttttgagtgaaatatgcctccacttctcattcagagaattcagtgcatacaaaatcagcttctgttgtatcatcagattccatttcaacttctgccgacaacttttctcctgatttgaggcccatgcagtccagttcgggagctaagtcacttaaacactgtgtgatagttcctacacatctcattatagtttgtcctgagggagtctaacaagttagcagaaatggaagaaccacccttgcttccaggagaaaatattaaagacatggccaaagatgtaacttatatatgtccattcactggcgctgtacgaggaactctgactgtcacgaattataggttatatttcaaaagcatggaacgggatcccccatttgttttagatgcttcccttggtgtgataaatagagtagaaaaaattggtggtgcttctagtcgaggtgaaaattcttatggactagaaactgtgtgtaaggatattaggaatttacgatttgctcataaacctgaggggcggacaagaagatccatatttgagaatctaatgaaatatgcatttcctgtctctaataacctgcctctttttgcttttgaatacaaagaagtattccctgaaaatgggtggaagctatatgaccctcttttagagtatagaaggcagggaattccaaatgaaagctggagaataacaaagataaatgaacgatatgaactttgtgatacataccctgccctcctggttgtgccagcaaatattcctgatgaagaattaaagagagtggcatccttcagatcaagaggccgtatcccagttttatcatggattcatcctgaaagtcaagccacaatcactcggtgtagccagcccatggttggagtgagtggaaagcgaagcaaagaagatgaaaaataccttcaagctatcatggattccaatgcccagtctcacaaaatctttatatttgatgcccggccaagtgttaatgctgttgccaacaaggcaaagggtggaggttatgaaagtgaagatgcctatcaaaatgctgaactagttttcctggatatccacaatattcatgttatgagagaatcattacgaaaacttaaggagattgtgtaccccaacattgaggaaacccactggttgtctaacttggaatctactcattggctagaacatattaagcttattcttgcaggggctcttaggattgctgacaaggtagagtcagggaagacgtctgtggtagtgcattgcagtgatggttgggatcgcacagctcagctcacttcccttgccatgctcatgttggatggatactatcgaaccatccgaggatttgaagtccttgtggagaaagaatggctaagttttggacatcgatttcaactaagagttggccatggagataagaaccatgcagatgcagacagatcgcctgtttttcttcaatttattgactgtgtctggcagatgacaagacagtttcctaccgcatttgaattcaatgagtattttctcattaccattttggaccacctatacagctgcttattcggaacattcctctgtaatagtgaacaacagagaggaaaagagaatcttcctaaaaggactgtgtcactgtggtcttacataaacagccagctggaagacttcactaatcctctctatgggagctattccaatcatgtcctttatccagtagccagcatgcgccacctagagctctgggtgggatattacataaggtggaatccacggatgaaaccacaggaacctattcacaacagatacaaagaacttcttgctaaacgagcagagcttcagaaaaaagtagaggaactacagagagagatttctaaccgatcaacctcatcctcagagagagc

SEQ ID NO: 157113 - DNA, 4464 bp, Homo sapiens
  Payload ID: 10792
  Gene Symbol: MTMR3
  Gene Name: myotubularin related protein 3
  Uniprot ID: Q13615
  ENST ID: ENST00000351488
  CDS Start-End: 285-3770
agaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatg

SEQ ID NO: 157114 - DNA, 5866 bp, Homo sapiens
  Payload ID: 10792
  Gene Symbol: MTMR3
  Gene Name: myotubularin related protein 3
  ENST ID: ENST00000323630
  CDS Start-End: 621-3809
gttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggt

SEQ ID NO: 157115 - DNA, 8906 bp, Homo sapiens
  Payload ID: 10792
  Gene Symbol: MTMR3
  Gene Name: myotubularin related protein 3
  Uniprot ID: Q13615
  ENST ID: ENST00000333027
  CDS Start-End: 329-3841
agcgcgctctgtgtggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgatgacccgttggcttcctgaccacctggccgcccactgctatgcgtgcgacagtgccttctggcttgccagcaggaagcaccactgcagggacactgaccgtgttgatcaaacgtggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttcctaattctttgccctgtggtttatcccctcttcgtcccttttccctctcacacagaagtgtttgagggcctgctgggaaactgacctttggcaaaggaaagctacagatagccttccgactctagaccttggcaaggagcctcaccatgatgttcaagcactgaacgcatttcctcagtgattttgctcctaaaatctcccaggctaaaagagggcaaagcagtcagggatctgacctggcagctattcctccttctctgaagagttcccatcagtagtcattacaactacctctcgcctcaaggctccatttttagctgctgctctgatttcagggcagccagtactctggccccttcagtcggggagtggaaggagatgtggggtgggggtgagaaaatgcttctgcctgttgttcttgaaggatagactatgggtgggcagagagaactgggggcagaaatggaattagatgtgattgggttatgcagtcaactagaggtctccttcccgccctctctccacacagagaggaacctctgctccttagctcttacagcaggactgtggcatctagtcacttcaatactagttcttgctcttcacagaggtagatttttctttaccctacagcactgttgggcatccctcccatcacatgggtctgtgggtgagatatgttatgctgttcctccctcgggaaggttggtattgaggggtgccttgctccagaggcgccagcccagcatctgtggtgagttggctaagatccagagtgacctgctcagagctccccagaggccttcactctttggggcagtctctctagggtcactttctgaatgtaccttctacctaaagtatacaaacacaaagagccagctgagctggttctagtgtgaaagccgtaagtgccacccagcaggcgtttgaaaacaagaaatcattcttctgtggaaggagaatgtgccatctcagctaccctcagtccgccaggcagcccagtctgtgtattcatatgaagttgtgaaaaccatgagtgtgtgccatggccatcgtgtctacacacagccactattgttcctgtgggctagtctccagcaaattaaaacactggcatggcctaggaagggcgttgcgagctcctaaatggaaagcttctctgggggtagggagatgaagagccaagatgctggtgaagcaggtgcagtgaggatccaaggcaaggaattgccctgagggaggtggctgcatatggagaaaggcagttctctgtgggcaaggccagcttgcttcaggctgtagagggaatttggtctgaagcaacagggcatgaactgtgactttgagctgccaggttgtcttcatctcagaactttcctatcctggcactctcgttacctttcttctataccttggcctctgtaactgcagtccaaaacaagttacagctgccttaatccactgagattctctatgaggatgtacagaaaagttttcctgtaataattttgcttatatgctaactcttttcatgttagcaaagaatattctatgaattagaatgttactgtggtagatctaaaggagaatgaacagaaggtgctggaggacctgttaaacaatctctggctattaaaaaacatcaagatgagaattaaaggcatatcctgatatacttgcctgcttgcacatgaggctgggagatcccatgcctgttgaagttaactctagccctgacctctattgatcttttgggaatgagggctgatttgaaggtgctgttgcaggatttcatttagctgctgccagttcaagtgacctgtccccagggctgcagctgtatccacctgattgcagtaggtgagggctaacagcagaatttaaagtggaccctgggctgtggagcaaagtgactatccatttggacttttggataatgtggcaggagtcccagctgtttaatttctagtcacattttccagaaagttgttctaagttgagattactgacaagatttctcaagggcaggaccagatatgtgagagacttctagttcagagctgacccctctaagcctctgacacttaaacacgagtcctgctgtccccagcacacaactgcactgaagccttgttcctctcggctggtgtagagctcatctgcatgttgtgtgcagataccagtagcctccctgcttgaacaggcctctcctaggctaggcaggtgttcagaggcatgaaggtctgggcaggggaagggcgtcttctgaaatgggagttaccaggtttttaaatgctgctattgttttatttaccatttaaggtcttttctattatatctgagtaactagtcagtttttcttacagtgctcatagcagttgtatttgaattgtattttcagtgaaatttgttttacattgccatttaaaattggcctttaacagcttcccaactagcttataagatttttttttttaatgaaaacataacccatgaggctcagatgctgttgaagaaataaatggtatgttgctgctgacagtagtgcttgcctattgtaacagcattggttctgctgtagcctcggtgaccatttaagttgaataaatctgtcattttcacccacaaacagttgttgagcccctggatttgggttgtcactgtggttctcctgccagtgctataatccagtgtcgtaggtgcagggtatgaatcagctcagcctcttaggagagaggggctctcagcgaggagggggcggggggggggtcactatttatcttccagaggcagggttcatggattcctgatgtttagaggcggaagggaccttaggtcacctacttccacggttttcatactgttctctggggcctcgtggagagggagcctccaggcccattcaaagctttattagatttaaaagtaagatctggtatgaagaaaggttttgtttgtttcttaaaataaaaagtctgaaaatcact

SEQ ID NO: 157116 - DNA, 3758 bp, Homo sapiens
  Payload ID: 10792
  Gene Symbol: MTMR3
  Gene Name: myotubularin related protein 3
  Uniprot ID: Q13615
  ENST ID: ENST00000406629
  CDS Start-End: 10-3522
cctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgatgacccgttggcttcctgaccacctggccgcccactgctatgcgtgcgacagtgccttctggcttgccagcaggaagcaccactgcagggacactgaccgtgttgatcaaacgtggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttccctt

SEQ ID NO: 157117 - DNA, 6018 bp, Homo sapiens
  Payload ID: 10792
  Gene Symbol: MTMR3
  Gene Name: myotubularin related protein 3
  Uniprot ID: Q13615
  ENST ID: ENST00000401950
  CDS Start-End: 343-3939
ggctcggcgtcgggagcgcgctctgtgtggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttccttgtgaaacctcctagtagaaaaagttcttgggacaaacttcatttgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtctatgccagtgaaaaagagcaacatggagacctgtgcagaccaggggagcatgtaacttcaaggtttaaaaacgaggtggagaggatgggttttgatatgaacaacgcctggaggatttccaacatcaatgagaagtacaaattatgtggtagctatcctcaagagctcatagtgcctgcctggatcactgacaaagaactggaaagtgtatcaagtttcaggtcctggaagcgcatccctgccgtcatctacaggcaccagagcaatggagctgtcattgcccgctgtggacagccagaggttagctggtggggctggcgaaatgcagatgatgagcatctggtacagtcagtagccaaagcttgtgcctctgactcccgatcgagtggcagcaagctgtcaactaggaacacttctcgagactttcccaatgggggagacctttctgacgtggagttcgattcttctctgtcaaatgcttcaggagcagagagtttagccatccaaccgcagaagcttttgatcttggatgcacgctcctatgcagctgctgtggcaaaccgagccaaaggaggaggctgcgaatgcccagagtattacccaaactgtgaagttgtgtttatggggatggcaaacattcattctattcggaggagttttcagtctctgcggttgctgtgcactcagatgccagatccgggaaattggctatcagctcttgaaagcacaaaatggctccatcacttgtctgtgcttctgaaatcagcgcttctggtagtgcatgctgtggatcaggatcagcggccggtgctagtacactgctcagatggctgggaccgcaccccccagattgtggcattggctaagctcttgctggacccttattaccgaaccatagagggtttccaggtcctcgtggaaatggagtggctggattttggccataaatttgctgaccggtgtggtcatggggagaactcggatgatctgaatgaacgttgcccagtgtttctgcagtggcttgactgtgttcatcagcttcagaggcaatttccttgctcttttgagttcaatgaagcattccttgtgaaactggtgcagcatacctattcctgcctgtttggaacattcctgtgcaacaacgccaaggagagaggggaaaagcatactcaggaacggacatgttccgtgtggtcacttcttcgggcaggcaacaaggctttcaaaaacctactgtattcctctcagtcagaagccgtgctgtaccctgtgtgccatgtgcgtaacctgatgctgtggagtgcagtgtacctgccctgcccatccccaaccacccctgtggacgacagctgtgcaccatacccagccccaggcaccagccctgatgatccccccctgagccggctaccaaagactagatcatacgacaatctgaccacagcctgtgacaacacagtgcctctggccagccggcgctgcagcgaccccagcctgaacgagaagtggcaggagcaccggcgctcactagagctgagcagcctggctggccctggagaggatcccctttctgccgacagcctagggaagcccaccagagtgccggggggtgccgagctttctgttgcagccggagtagctgaggggcagatggagaacatcttgcaggaggccaccaaagaggagagtggagtagaggaacctgcccacagggcaggcattgagatacaggagggtaaagaggaccctctcttagaaaaggagagcaggaggaagacacctgaggcctcagccattggacttcaccaagacccagaactgggtgatgctgctctgaggagccatctggatatgagctggcctctgttctcacagggcatttctgaacagcagagtgggctcagtgttctcctcagttctctccaggtcccccccaggggagaggattccctggaggtccctgtggagcagtttcgaatagaagagattgcagagggtagggaggaagcagttcttccaatcccagtagatgcaaaagttggctatggtacctcacagtcatgttctctgctaccttcccaagtcccttttgagaccagaggaccaaacgtggacagttctacagacatgttagtggaagataaggtgaagtcagtaagtgggccccaaggtcatcatagatcttgccttgtaaatagtggcaaggacaggcttcctcagaccatggaacccagcccttcagagacaagcctggtcgagaggccccaagtggggtctgtggtgcataggacttcccttggcagcactctcagcctgacacgttccccttgtgccttgcctttagccgaatgtaaagaggggcttgtgtgcaatggtgccccagagactgaaaacagggcctcagagcagcccccaggtcttagcaccctccagatgtaccccacacccaatgggcattgcgccaatggggaggctggtaggagcaaggactcactgagccgtcagctgtctgctatgagctgcagctctgcccacttacactcaaggaacttgcaccacaagtggctgcatagccactcaggaaggccatctgcaaccagcagccccgaccagccttcccgcagccacctggacgatgatggcatgtcagtgtacacagacacgatccaacagcgcctgcgtcagattgagtcaggccaccagcaggaagtagaaactttgaagaaacaagtccaggagctgaagagtcgcctggagagccagtacctgaccagctccctacactttaatggagactttggggatgaggtgacttcaatccccgactcggaaagcaatctggatcagaactgtttgtctcgctgcagcacagagattttctctgaagccagctgggagcaggtggataaacaggacacagagatgacccgttggcttcctgaccacctggccgcccactgctatgcgtgcgacagtgccttctggcttgccagcaggaagcaccactgcaggaattgtgggaacgtattctgctccagttgttgtaaccagaaggttccagttcccagccagcagctctttgaacccagtcgagtatgcaagtcttgctatagcagcctacatcccacaagctccagcattgaccttgaactggataagcccattgctgccacttccaactgaagctcagtgacctgggtgggcagtggccaagctgctgttcctatgacaggcccactcaacctgggcagaccgagaggcccgtgcactttggaatgggagcgtggaaccacctgtacagagtgacagatttgggatgcaccactggattgtagattgatttttctttcctgtccccctactccctccctaccttttccatcctcctcctctgccttcaaaaaaggaaactttcccttggttgtcttaattttttttttttttgatggaagaccaagggttgccaggcccactgtaactgccgagctgcctgctgtcacgtgacactgagggatggcttgtttcttccgggtgggaggatggtggtcagagccaggagtatggagatctgagaccgtgagcagggaagaaagccagtgctaacatgcaaccattcctcacgccaccgccacatcagagctggttgggaaccctttgctgctggggaggctggaagcatattccccaagagcactgccctgggcatcatctccctcctgcgaggagctgagccagtcccctcacagatggataaatgaggctgatgtttggagggagaggcacacggtaaatggcatccccttaggcgcctctttgggaaaggaaagtggatgctcctttgaggcaggcgaggggctgggagtgggtagccgtcatgttgtcccccgtgggatcccatttttaacttgacccagattgtcttgggctccttttactttcagggggctgctttcctgggccaggctgtgtagcacttcccaccctcaggcatgagtacagactggtcaaaatgtttatgcagtcaaggccaaagcctgccctgagcccagacacacctgggtccccattctggggcctggtcccctaaacaatctcttcctcagccagcacagggaaatccagactcagggttccagaaatcccccgttcccaaaccaaaccaatcatggatcttccctttaaggggtagaatcagcctttagagttacaagcccctggaaaagggagcaggtcccatacaatcagcctttctcctcttctcttcttgggacaggaataactgctgagcagtccccctttgccactcctggctgtctgagtgggcacttgtctggctgctggccagcagtgaagggccacttggtgacttcgtagggttccttagagaagtgacatggccttgaggagattcagggcacctttcctcagtgagctttgatatggtccaaaaacagccttaaatcaagaatatttgtggaggtaggtgtggggaaggttggagaagagttaggtttgtgctttgtaatcttggcatccatgttttgtgcctgccctccctcttggggaggccatgcttgactctgctgaaagctgctaactggtgacagggtggatcatggtgaggactaggggtaaggtcagggaatgcttaagctctggccctgccctgtattcctcttccccttggtagcagttccctgaccaagggcaaggtgtgtctcaggaaggtggttctgtgcatgcctgggtgtggttaaggcgtggcccagaaggcttccctggtgctctcagtccaggcaaagcccagagcatctgagcacgtctctgacttccagtggcaacacagtttgaacgtggtgaaacagggtgtagttcttttccacattctgtgtcatctagtcgtgcaggtagggaaaaagttggtctaattgaagattgtgcatttcctagtgacaggtgccaagaggttatgatacgggtttcttgggtctgatgtacagtgtgaataaatgcttgcagctcttagctcttttttgatcgatgaagcacttttttattaatattttcctttgttaaaggaggaaccgtaactctccatagctgtacatataacccttttctcctaaagaggagtcagtcagtgctcctatatttttcattttttgtcaaagcaagaagtaaatactttagaattgttaaatatataaataaagcaaataaagttgagtgttccacatggtagcatttgctaacacttcctaa

SEQ ID NO: 157118 - DNA, 665 bp, Homo sapiens
  Payload ID: 10792
  Gene Symbol: MTMR3
  Gene Name: myotubularin related protein 3
  ENST ID: ENST00000445401
  CDS Start-End: 248-665
tgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgacttcaccataagggaaagaagagagccttgttggacactgaagaagggacggggatttctcctcctaatctgggcctcttgtcatggatgaagagactcggcacagccttgagtgcatccaggccaatcagatctttcccaggaagcagctgatccgggaggatgagaatcttcaggttcctttccttgaacttcatggagagagcacagagtttgtgggccgtgccgaggatgccatcattgccctttccaattacagacttcacatcaagttcaaggagtctcttgttaatgttccattacagcttatagaaagtgttgaatgccgagatatatttcagcttcatttgacttgcaaagactgcaaagttatcaggtgtcagttttcaacctttgagcagtgtcaagagtggctgaagagactgaacaacgcaatccgaccacctgctaaaatagaagatctcttctcatttgcataccatgcttggtgcatggaggtct

SEQ ID NO: 157119 - DNA, 5839 bp, Homo sapiens
  Payload ID: 10793
  Gene Symbol: MTMR4
  Gene Name: myotubularin related protein 4
  Uniprot ID: Q9NYA4
  ENST ID: ENST00000323456
  CDS Start-End: 126-3713
ggtggggtcgggactgcgcggcctcagcagctgcgggagacggaagtggcaagagcgcggcctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagt

SEQ ID NO: 157120 - DNA, 1281 bp, Homo sapiens
  Payload ID: 10793
  Gene Symbol: MTMR4
  Gene Name: myotubularin related protein 4
  ENST ID: ENST00000582390
  CDS Start-End: 218-556
actcgtgcgggagggcggagctgggcccgctccattgtggagaggaggggagaggcgcgcgggagccgcgcggaggcccggccaccagcgccctagcctcttggccgccgcggctgcacctggcgagccccgcagccgggatgcggcgggcgcccggggctggcgggcagcgcagcggctccggggacatgtgcgctggcccagaccgcccgcgaccatgagcctgaccgcccgcgtctcctgctccatgcttagctgcttcggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgagaacaacggagcctcactcaggtcccctggccctagtcttgtccagttctctgtgctgcagggtttctctggtgcaagagaggaaagatcctgcctcactttccccagttggaagaaaaggtgaagaccatgttctgggttgggaggtcagtttactgacccataggatcttgacctgaaaaaatgggggtaatgcctagttcatggagtcatcgtaaggattaagtgagataatgtgtatgtgtatgaaagcaccgaggacaatatctggcacagagcactcatattattgttggtttatttatttattcatttgatatacatgtattgagtaccctactcaatgccagcctgttttaagccctggggatacagcagggaacaaatagacaaaattttgccgcctcagagagcttacattccaatgaggagataccaaccgtaagtaataagtaaaatttgtgaaatgatagtaagtgtaaaggaaaaaaataaagcagggaaagggaataaggagtgctatgagggtgaagattgtaaaacaatcaggctgggcacggtggttcacgcctgtaataccagcacttcgggtggccaaggtgggaagatcccttcagcttaggagttcaagatcagcctgggcaacatagcgagaccccatctctactaaaaatagaaaaaattagccaggcgtggtgatgcatgcctgtagtcccagctactca

SEQ ID NO: 157121 - DNA, 425 bp, Homo sapiens
  Payload ID: 10793
  Gene Symbol: MTMR4
  Gene Name: myotubularin related protein 4
  ENST ID: ENST00000579921
  CDS Start-End: 140-425
agggtcgggcggacgccgcctggtgagaagcaggcagccagtacccttgccacggtagaatggagcgtggaatgactaacctggcaccattctaaggggaaagaaaggtttaacgaagtcacgggattgaaggaccctgatgggcaggggcatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgca

SEQ ID NO: 157122 - DNA, 810 bp, Homo sapiens
  Payload ID: 10793
  Gene Symbol: MTMR4
  Gene Name: myotubularin related protein 4
  ENST ID: ENST00000583656
  CDS Start-End: 218-810
actcgtgcgggagggcggagctgggcccgctccattgtggagaggaggggagaggcgcgcgggagccgcgcggaggcccggccaccagcgccctagcctcttggccgccgcggctgcacctggcgagccccgcagccgggatgcggcgggcgcccggggctggcgggcagcgcagcggctccggggacatgtgcgctggcccagaccgcccgcgaccatgagcctgaccgcccgcgtctcctgctccatgcttagctgcttcggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaa

SEQ ID NO: 157123 - DNA, 5622 bp, Homo sapiens
  Payload ID: 10793
  Gene Symbol: MTMR4
  Gene Name: myotubularin related protein 4
  ENST ID: ENST00000579925
  CDS Start-End: 72-3488
gcgcggcctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagtgctgcttt

SEQ ID NO: 157124 - DNA, 572 bp, Homo sapiens
  Payload ID: 10793
  Gene Symbol: MTMR4
  Gene Name: myotubularin related protein 4
  ENST ID: ENST00000582663
  CDS Start-End: 76-372
aagagcgcggcctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttg

SEQ ID NO: 157125 - DNA, 317 bp, Homo sapiens
  Payload ID: 10793
  Gene Symbol: MTMR4
  Gene Name: myotubularin related protein 4
  ENST ID: ENST00000583243
  CDS Start-End: 269-317
tgcttggggatgtgggatgtggctagtaggctgaatgggatgttaggagggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcct

SEQ ID NO: 157126 - DNA, 5659 bp, Homo sapiens
  Payload ID: 10794
  Gene Symbol: MTMR6
  Gene Name: myotubularin related protein 6
  Uniprot ID: Q9Y217
  ENST ID: ENST00000381801
  CDS Start-End: 763-2628
tttcgttatgtgatatccctctacaggatgagttttaatggatgctggtgctaacatcgtatgaaattgaggtaggaggcgggactctgacaccagaccagattgaggactagctaatcatcatactttacataaggaatccgtaggattggagagttgattgtttcaaataaggctggtttccttatttggttatttccttagaataataactccaaatctgattatttccttagaatacattcttatgagtagaactgcagctcaaactaaatttggtgctgtccagtggtatggcgatggacttcagaacatcctccactcttgccctcaccccacaagaaccctttactcgggatccattctcacgcagtcttcctccccgaccgccccgcgcgtccgctcggcgggatgacaaagaccgcctcgggtggggtggtgagcagtaccggcctcctccagcagggggcgctgtgggatccgccgctgtccgggacgaaccagcaagccgctctcggtccacacacgctctgtctgcctgccccgagtcccccgggaggccgcggggtttggggaagtgtttctaggagacggcgctcaccggctgcacctgcgccgttgacgccaccggggccggcagacagacccgcggcgctggctggtggagggagttcccgcttgctctctgtcgctgtcaccgccctgtttctgtagccgtatggtacgcctgtgagaccggctgccggctgacgtctccttgcgatggagcatatccggacgaccaaggtcgaacaagtaaaattacttgaccgattcagtaccagcaacaagtcattaacaggaacactgtatcttacggctacacatctattatttatcgactctcatcaaaaagaaacctggatattacaccaccatattgcctcagtagagaaacttgctttgactacttctggatgcccccttgtgatacagtgcaagaacttcagaactgtgcatttcattgttcccagagaaagagattgccatgatatttacaactctttgctacaactgtcaaaacaagcaaaatatgaagatctctatgcattttcttataatcccaaacaaaatgattcagaacgactacaaggctggcagctcattgatctcgctgaggaatataagaggatgggagtgccaaactcacactggcagttgtctgatgccaaccgggactacaagatttgtgaaacttaccccagagaactttatgttccccggatagcaagcaaaccaataattgttggtagttccaagttccggagcaagggaagattcccagttctttcctactatcatcaagataaggaggctgccatttgtcgatgtagtcagccactctctggattcagtgccaggtgcctggaggatgaacatttgcttcaagccattagtaaagccaatccagtcaatcgctatatgtacgtcatggataccaggccaaaactgaatgcaatggccaacagagcagctggaaaaggttatgaaaatgaagacaactattccaatattagatttcagtttgttggaattgaaaatattcatgtcatgaggtccagccttcagaaattattggaagtcaatggcactaaagggctttctgtcaatgatttctactccggtttggagagctcgggatggcttcgccatatcaaagctgttatggatgctgcaatcttcttggccaaagcaataacagttgaaaatgcaagtgtgttggtgcattgttccgatggttgggataggacttcccaggtttgttccctgggttctcttttattggattcctactacaggacaatcaaaggattcatggttttaatagaaaaggattggatctcttttggacataaattttcagagaggtgtggccagttggatggtgacccaaaggaagtctcaccagtgtttactcagttcttggaatgtgtgtggcatttgaccgaacagtttccacaagcctttgaattcagtgaagcatttcttcttcagatccatgagcatattcattcatgccagtttggaaacttccttggaaattgtcagaaggaaagagaagagctcaagttgaaggagaagacttattccctgtggccatttcttttggaagaccaaaagaagtacttaaatcctctctacagttccgaatctcacagatttacagttttggagccaaatacagtatctttcaattttaagttttggaggaacatgtaccatcaatttgatcgaacactgcatcctaggcagtctgtatttaatataattatgaatatgaatgagcaaaataaacaattagagaaagatattaaagacctagaatctaaaattaaacaacgcaaaaataagcaaacagatggcatcctcaccaaggaattgttacattcagttcatcctgaatcacctaacctcaaaacttccctgtgttttaaagagcagactctgctacccgtaaatgatgctcttcgaactatagagggcagcagcccggcagataatcgttatagtgaatatgcagaagagttttctaaatcagaacctgctgtggtcagcttagagtatggtgtggcaagaatgacttgttagactcatagagttttttctgcaatgattgcagtacaagaaaaggattattgtgaggatggtctgtaagcataaccaaaaggaatttgtctaataacaattttagggtttaacagtaggctaatagttgaaggaaggataataactacccttgtgagagaaataagtcattttaattgcatttccagcaaggaatgacattcagttctgtaagaaatgagtggtatttgatgtatttactcaaaacacaatttgcactgtacactagtgaattgacgtttatgatttatgttaattcagccaaacataaataaccttccttaagtacaatttaacttcaagaaaacaaaatttgacaacatagtttcttaataaatgatatggcatgtactttcaattatgtagctttgtaactatgaatatttacatattttgccttttagtgatatttaatgttaaagtgccatgaaaaatatttctaagaaagccttaaattcccagtggattctttacccttaagttttacagcctacaacaagattttttgttttgtttttcttctggtcagccttgttttgtttgtaaagaattgtgctctcattactgctgggggtgcatgctacaatacttctatataaacacttgtagaagtacactgttcacgtttagcctgccccacttttgtattcaaaattaatgaaactgaaggtttattctgatcataatttgtttagtgctacatttgataatttattatttacagcttagaatattgatttcttgaatacgtataagcacatttgactgtcttttatatatggattactgcattccattgattcttattttgtggttggctttatttctttcacaactgtgtaagtttaaagagctaaagctctaaaactgttctgagaaacaatgaatagtacatgtatatgtatatttttaaactgccttattgctcaatgagttgctgttcctggagtatctaactttcagtttactcaaaaacttttgggtaaataaaaaagggaagtacagatagtttaggttgtgcatggttgcatgaattttgaagtcatttctatgtggagcattatttttcttcttgttaaatatagaaaaaaaaagagattctagtacaaagttactgtttaacaaaagcaacataaactctgggaaagatttcattttgccatgttatatttactgtttattctgtgtactagtacatatctttaaattaccaaaaaacaagaaacaaaacataaaaaccccaaaactatcacttggaattagcaatatcacccaactggctttaaaattgaaaatttaaataacatggtggcatgaagtacaattcgagtattaggcaatttgcatagtgttcctcatgctactttctgttacacctctattatattagttttgaatataaacatctttttcagaccaaaaaaaactttattgtatgagagcttatcttatcctgtttatttttccaatgcttttctgtaatacattatgtaatttaaaaaatattcctttttaaacagcaacagaaatgcactataaaatatagtatgtgattaaccaatcctgcttccatatttaagcactgggaatggaaacttaatctctgtgactacaaagggaagtttttgtgccttggtgttccagtcactgattgtggttttagaatcttctgtggctgacttcttgtattcaactctggtttattatcttaatcttcaacttcagacatatatttgtgtgtttatatgctcacaggtggactgagaaatcagttacatcttaagtgacctacagggtatatgttggcaaaagcagactgtgtatatgtcttataaagttgaatttatgttcagtgtgtttggaagtgtatagcatgtaaattacttcatatatgatttaaaggtaattaaatgttcacattttactttgaatgtttttcttctggataaaacaaatggaatcaagttgtagttgttttttttttcttctcacctaggcaagtagacttgcccattacattaacataacagcataaggtttgaggagtttattttccaaaagtttgttgataaataatacctgtttcatacaaaaataatttccagaatatttaaaataggtatagtgggctaaaaggcccatcagatgtaggtaataatgtcattaagttttcattttgttcctgtcacttgcttatattacaatcactatttttttgtgcccttgccaacttgatggaaggcagggtccattgagtacaaacattcgaggtgaaatgtctctccaaaggcagatctggatgtaaatatgaggaagaaaataactggctgacaagaggataattttattgagggtgttttgaaaaggtcagctaggctagaagtagctcagggaatcttgagtaaagatgaagggaactcttttaaaacaaattcaatttatttggtcgggtagcagagcagggaggtggtgtcagtcaagcctgttttgaaacattttttgcagaaggtcagctttaaaatattgaaaaatttccagttgacatgctaagttggattaaatgctgatcatttataaaactatatagttgctgcaaaagtaattggggcttttgccattgaaagtgatgacaaaaaccgcaattacttttgcaccaacctaatactacagttgcagacttttattagtgacgctgatcttcattagtcaagttttagttattttgttggcttttccatgtagaattccaagtgacattaacatactttgattaattaaagaaaatttggagactgtttaagatatatgtctagatatcaatgtaaactataagctttaggaacttacatctagaagaaagcctggaatctagaataattatctcaaaaaaaagtatatataccattgtacttgatataagaaaatgtaaacatgaaaccttgacattttaataaacagtatttgtgctactctagttatttctaggaaagtaaaa

SEQ ID NO: 157127 - DNA, 3850 bp, Homo sapiens
  Payload ID: 10795
  Gene Symbol: MTMR7
  Gene Name: myotubularin related protein 7
  Uniprot ID: Q9Y216
  ENST ID: ENST00000180173
  CDS Start-End: 36-2018
gcgcccgcccgggaccctgcagacgtgggccagccatggagcacatccgtacgcccaaggttgaaaatgtccgcttggtagatcgagtgtctcctaaaaaagcagctctaggtactttgtatttgacggctacccatgtcatattcgtggaaaattcacctgacccaagaaaagaaacatggattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccagtgaaatatgaggagttatactgcttttcattcaaccccatgctggataaagaagaaagagagcaaggctgggtgctgatcgatcttagtgaagaatacacgcggatgggcctccctaatcattactggcagctcagcgatgtgaatagagactacagagtctgtgactcttatcctactgaactgtacgttcccaaatcggccacggcacacatcatagtggggagttccaaattccggagtagacggcgatttcctgtcctttcttactattataaagataaccacgcctccatctgccggagcagccagcccctgtccggcttcagtgcccggtgcctagaggacgagcagatgctccaggccattaggaaagccaatccaggaagtgacttcgtttatgtcgttgacacccggcctaaacttaatgcaatggcaaatcgtgctgcagggaaaggctatgagaatgaagacaattattccaatatcaagtttcagtttatcgggatagagaacatccatgtcatgaggaacagtctgcagaaaatgctggaagtgtgtgaacttaaatctccctccatgagtgatttcctgtggggtctggagaactctggctggttaaggcacattaaagccataatggatgcaggaatcttcattgcaaaggcagtgtcagaggaaggggcaagtgtgcttgttcactgttctgatggctgggacaggaccgctcaggtgtgctcggtggcaagcctgctgctggaccctcactaccggactctgaagggcttcatggtattaattgaaaaggactggatttcctttggtcataagtttaatcaccgatatggcaatctagatggtgacccaaaagaaatctctccagttattgaccagttcattgagtgtgtttggcagttaatggaacaatttccctgtgcctttgagttcaatgagaggtttttgattcacattcaacatcacatttattcctgccagtttggaaacttcctatgtaacagccaaaaggagagacgagaactcaagattcaagaaagaacatactcattatgggctcacctgtggaagaatcgggccgactacctgaatcctctgtttagagctgatcacagccagactcagggaacccttcatctccctacaacaccatgtaacttcatgtacaagttttggagtggaatgtataaccgctttgaaaaggggatgcagccccgacagtcagttacagattacctaatggcagtgaaggaagaaactcagcagctagaggaagaactagaggccctggaagaaaggctggaaaaaattcaaaaggtccagttaaattgcactaaggtgaagagtaagcaaagtgagcccagcaagcactcagggttttctacctcagacaacagcatagccaacactccccaggattacagtgggaatatgaaatcatttccatcccggagcccttcacaaggcgatgaagattctgctctgattctaacccaagacaatctgaaaagttcagatccagatctgtcagccaacagtgaccaagagtccggggtggaggatttgagctgtcggtctccaagtggtggtgagcatgcaccgagtgaagatagtggcaaggaccgggattctgatgaagccgtgtttctcactgcctgaagtttccctttggagttccaaagtaaaggacacataagcaacacttccaaaaacaagggaacaaggtggtttattgtaaaaacaggaaatggtgcatgtcattgagaactactttaatgcagctatgaaaagggaaaaaagtgcccagttcttgatttcttagatactgaagaggacgtagtcatttcatttatcaaatataaggaaaattattcaccattttgaagctcaccctagactatgaaaattatattcactgcagagcaattacttctgtcattacctgaagtgatcagtatctatcttccttgtcatagcatgcatctctcaaaaagcctccactcctttccctcacatctgtgatcatcatgattcttttagttcacttctagatgcatattttgtgttttctaaagcatctgacattatcctcctttccgaccctcttatacatatttctaaaaacaggcacattggtgagatgcaccctttttagttaatagatgcattcctaaggagcttttaattgcttatctttcaggcataatcatcactttaacttttccttggagcatatattttgaattgtgagaataattttgttgcttttctctgagatctatagtctgtttctcctcattatttaaaaatgctaaaccttgtatctcactttttctctaacactgatttaatagctaacgaggtagaagcaacattcattctcctggtcttacatatgaatttaagtatcagctttcttgtaataaccttttattactgttctagagactacactaccgacagtgtgggccagccaccagcctgatctcaaagtatcacattataaagttagtagataaaacatctgtgagtgaaaatccagtttcaagaaccagagaattgggttgtcatgtctgtttaatgaagggaataggttttgtaatctatcattttagaaattatgtaactggctaatatggtttaattaaccttagtaacatctcatgaccactgactgctgaaagttctgaaaagaatttttgttttgttacactgcacatttaagggagagtccctcccctatcttatgagttaaaaaagacttcactaggtgacctaaattaaacttagtggggaaaagtggccatgtttggacataaataaatggtattcacactgtatggttttaatatattagtacattctagaatgtaaaaggattaaactttacaatttagatcaatattttgaatatgtgaaaggattaatttaaactttacaatttacatcaatattttgaatatctgattttttttaatgggagaattattacatttcgctgaaatgaggacgagggcaagaaagcaacattgctgatctctctagtatgaaagatttggagggagtgttgcaatatatataaatgaaaacatttaattgtgttcatcatatttaaaaatatagaatatattagagaactgtgatttaaaagtactgttaatgtaaaaaataaagcaagtgtaattaattctttcagaatataaaatttgggcattctctgctgagcagttcccaaattaagtacaaggaatgtttattcattttctgcaatatactatatgtaatagggaataccttgctaaaataaaacttaggatatagtggtaatggctttcacatttttataacataacataactcacttcacaaccttcttggagctgtccactcttagaaactctgttgcctaatattgaggatgtggctttaatttcttccgtttgacagtgtatgtctataaaaacaataaacattttttaaaaaatgacaaa

SEQ ID NO: 157128 - DNA, 2158 bp, Homo sapiens
  Payload ID: 10795
  Gene Symbol: MTMR7
  Gene Name: myotubularin related protein 7
  Uniprot ID: Q9Y216
  ENST ID: ENST00000521857
  CDS Start-End: 36-1703
gcgcccgcccgggaccctgcagacgtgggccagccatggagcacatccgtacgcccaaggttgaaaatgtccgcttggtagatcgagtgtctcctaaaaaagcagctctaggtactttgtatttgacggctacccatgtcatattcgtggaaaattcacctgacccaagaaaagaaacatggattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccagtgaaatatgaggagttatactgcttttcattcaaccccatgctggataaagaagaaagagagcaaggctgggtgctgatcgatcttagtgaagaatacacgcggatgggcctccctaatcattactggcagctcagcgatgtgaatagagactacagagtctgtgactcttatcctactgaactgtacgttcccaaatcggccacggcacacatcatagtggggagttccaaattccggagtagacggcgatttcctgtcctttcttactattataaagataaccacgcctccatctgccggagcagccagcccctgtccggcttcagtgcccggtgcctagaggacgagcagatgctccaggccattaggaaagccaatccaggaagtgacttcgtttatgtcgttgacacccggcctaaacttaatgcaatggcaaatcgtgctgcagggaaaggctatgagaatgaagacaattattccaatatcaagtttcagtttatcgggatagagaacatccatgtcatgaggaacagtctgcagaaaatgctggaagtgtgtgaacttaaatctccctccatgagtgatttcctgtggggtctggagaactctggctggttaaggcacattaaagccataatggatgcaggaatcttcattgcaaaggcagtgtcagaggaaggggcaagtgtgcttgttcactgttctgatggctgggacaggaccgctcaggtgtgctcggtggcaagcctgctgctggaccctcactaccggactctgaagggcttcatggtattaattgaaaaggactggatttcctttggtcataagtttaatcaccgatatggcaatctagatggtgacccaaaagaaatctctccagttattgaccagttcattgagtgtgtttggcagttaatggaacaatttccctgtgcctttgagttcaatgagaggtttttgattcacattcaacatcacatttattcctgccagtttggaaacttcctatgtaacagccaaaaggagagacgagaactcaagattcaagaaagaacatactcattatgggctcacctgtggaagaatcgggccgactacctgaatcctctgtttagagctgatcacagccagactcagggaacccttcatctccctacaacaccatgtaacttcatgtacaagttttggagtggaatgtataaccgctttgaaaaggggatgcagccccgacagtcagttacagattacctaatggcagtgaaggaagaaactcagcagctagaggaagaactagaggccctggaagaagtaagacatacttgctttgttaatctattttctgtgcttatttcttgaagagcaaggcttcatgaaagcctcttaagattcagtgcaatacaaatatttcacatttttagtcagtagaacacctgaaacacaaccccatccaggtcaggactcagataaccgaagcccaaacctaggcatttaatgcatttcacacatctggtttgtggctcagttccacaaatttttggttgttccttattttaggtcaacttgtttggttactgttatttgagagtagtaaaattaatttttttctggaaagtgtgaaaaagtaacagaataaaatcaaatatatgtacttgtaaaactctttccccacttttagaaattatgttaactatgatattaatctataattggtaaaggggagactgactgtaaagtcttatcttttggcttctatgaacttccctgtacttggacagggaggttataataaaatgcttttcctaattggataa

SEQ ID NO: 157129 - DNA, 739 bp, Homo sapiens
  Payload ID: 10795
  Gene Symbol: MTMR7
  Gene Name: myotubularin related protein 7
  ENST ID: ENST00000517317
  CDS Start-End: 16-333
agacgtgggccagccatggagcacatccgtacgcccaaggttgaaaatgtccgcttggtagatcgagtgtctcctaaaaaagcagctctaggtactttgtatttgacggctacccatgtcatattcgtggaaaattcacctgacccaagaaaagaaacatggattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccaggtctgtgactcttatcctactgaactgtacgttcccaaatcggccacggcacacatcatagtggggagttccaaattccggagtagacggcgatttcctgtcctttcttactattataaagataaccacgcctccatctgccggagcagccagcccctgtccggcttcagtgcccggtgcctagaggacgagcagatgctccaggccattaggaaagccaatccaggaagtgacttcgtttatgtcgttgacacccggcctaaacttaatgcaatggcaaatcgtgctgcagggaaaggctatgagaatgaagacaattattccaatatcaagtttcagtttatcgggatagagaacatccatgtcatgaggaacagtctgcagaaaatgctggaagtgtgtgaacttaaatct

SEQ ID NO: 157130 - DNA, 2639 bp, Homo sapiens
  Payload ID: 10796
  Gene Symbol: MTMR8
  Gene Name: myotubularin related protein 8
  Uniprot ID: Q96EF0
  ENST ID: ENST00000374852
  CDS Start-End: 69-2183
ggcggctagaccggtggcggcggcatctggagtagcactgagatcttccggtggcgggaactgcagtcatggatcatattacggtacccaaggtagaaaacgtgaaattggtggatcgttatgtgagtaagaaaccagctaatgggattctttatcttactgcaacccacctgatctatgtggaggcttcaggtgcagcccggaaagaaacatggattgcactccatcacattgccactgtggagaagttacccatcactagcctgggttgtcccctgaccctccgctgcaagaatttccgggtggcccactttgttttagattctgaccttgtgtgccatgaggtttatatttcactgctcaagctttctcagccagcattacctgaagatctttatgctttttcttataatcccaaatcctcaaaagagatgagggaaagtggatggaaactgattgacccaatatcagactttgggcgtatgggaatacccaacagaaactggaccataacagatgccaacagaaactatgagatatgcagcacctaccctcctgaaatagtggttcctaaatctgttaccttgggaacggtggttggaagttcaaagttcagaagtaaagaacgtgtccctgtgctctcctacctctacaaagagaacaatgctgccatttgccgctgtagccagcctctctctggattttacactcgctgtgtagatgatgagctcttgttggaggccattagccaaacaaacccagggagccagtttatgtatgttgtagacacaagaccaaagttgaatgccatggccaaccgagcagctgggaaggggtatgaaaatgaagacaactatgccaacattcgcttcagattcatgggcattgagaacatccatgtaatgcggagcagtctgcagaaactcttggaagtttgtgaattgaaaactccaacaatgagtgaatttcttagcggcctggagagctcagggtggttaagacacattaaagctattatggatgctggaattttcattacaaaggcagtgaaggtagaaaaggccagtgtcttagtccattgttctgatggatgggaccgcacagcacaagtctgctcagtggctagcatcctcctagatccattttataggacattcaaaggactcatgatcttgatagagaaggaatggatatccatgggccacaagttttcccaaaggtgtggccacctcgatggggactctaaagaagtgtcccctatcttcacccagttcctagactgtatctggcaattaatggaacagtttccctgtgcctttgagtttaatgaaaacttcctgctggagattcatgaccatgttttctcctgccagtttggaaacttccttggtaactgccagaaggatcgggaagatctaagagtctatgagaaaacacattctgtgtggcctttcttggttcagaggaaaccagacttcaggaaccctctctataaaggcttcactatgtatggggtactcaatcctagtactgtgccctacaacattcagttctggtgtgggatgtataaccgctttgacaaagggctgcagcccaagcagagtatgctagagagcctcctggaaattaagaaacagagagcaatgctggagacagatgtgcatgaactagaaaagaaactaaaagtccgtgatgagccaccagaagagatctgtacctgctctcaattaggaaacatattatcccagcatctgggaagtcctttgaccaatcctcttggctttatgggtatcaatggagacctgaataccctgatggagaatggcaccctatccagggaaggaggcctccgagctcagatggatcaagtaaaaagccagggtgcagacctccaccataactgttgtgagattgtgggcagccttagggccataaatatctctggggatgtgggcatctctgaggccatgggcatctctggagacatgtgcacctttgaggctacgggcttctccaaagacttaggaatctgtggggccatggacatctctgaggccactggcatctctggaaacttgggtatttctgaggccaggggtttctctggggacatgggcatcttgggggacacaggcatctccaaggccagcaccaaggaggcagactactccaagcatcagtgagttagttactcatcttccatgctaggtatacctacagcagctacaatgattcttgtcccagagagggctatgctgcttttccaattggtttaagtgggtgaagccagggcacccctctccccacttaagtctggaagggaattactttactgattaagtgaccaatatgttcatattaagcagtacagagtgtaggcaagagaaagaatatgttattgttctaaaatgggatttaactatagaaatgttgcctctcagctgagacacatattaagctggttctactgtctgttttccttaatgatcgacctgccctattttctatcctcactgcagtaatgtgaaagtgaagtggaaatattgtcacaatggtcaataatgacccttttgagggtatggagagatggtatacagcaggtaactgtgaattgcagaataaattgaaagaaaatttta

SEQ ID NO: 157131 - DNA, 7481 bp, Homo sapiens
  Payload ID: 10797
  Gene Symbol: MTMR9
  Gene Name: myotubularin related protein 9
  Uniprot ID: Q96QG7
  ENST ID: ENST00000221086
  CDS Start-End: 474-2123
gtcttccgagtttcgagacctgctgcttccgcccggagttgttgtgggctccagcagcgagtagccacttccgctaggagtccctagcggccagggcgtggaagcggattctgaggcggctttctcctactgccctccgcttgccaacgcgggacccggagcccaacggcagcggcggtccttgggcctgtggagaggggttctctgtggccgagtcctaggcctggtgaaccgcgcggtgcgggagaggcgcttgggcctcgtccagccccagcccctgtctccccgcggccggtgccggcggctgtaggcctcgccgcgcccacccagcctggggcgggcccagcctcaccgcccggcccgccccgccccacgggccagccccgcgccgggtgtttccgctacttccctgcggcggggtaaccgcctcgcacctaccgggctcggttccctggctccggccgcgggggagcatggagtttgcggagctgattaagaccccgcgggtggacaatgtggtgctgcaccggcctttctacccggctgtcgagggcaccctgtgcctgacgggccaccacttgatcctgtcctcccggcaggacaatacggaggagctgtggctcctccattcaaacatcgacgccatcgacaagcgatttgtaggatcactgggtaccatcatcataaaatgtaaagattttcgaattattcagttggatattcctggaatggaggaatgcttgaatatagccagttccattgaggcattgtctactctggactccatcactctgatgtaccctttcttttaccgtcctatgtttgaagtgatagaagatggctggcattccttccttcctgagcaagaatttgaactctattcttcagctaccagtgaatggaggctaagctatgtcaataaggaatttgctgtctgtccctcttacccaccaattgtcacagtgcccaaatccatcgatgatgaagctcttcggaaggtagctacatttcgacatggagggcgcttcccagtactaagctattaccacaaaaaaaatgggatggtaattatgcgaagtggtcagccactcactggtacaaacgggaggaggtgcaaggaggacgagaagctgataaatgctaccctcagggctggaaagcgtggctacatcattgacacccgatccctgaacgtggctcagcaaactagagccaaaggaggtggctttgaacaagaagctcattatcctcagtggaggcgaattcataagtccattgagaggtatcacattcttcaggagagcttaatcaaacttgtggaagcttgtaatgaccaaacacataacatggaccgatggctcagtaaattggaggcctctaactggctgactcacatcaaagagattctgacaactgcctgcctagcggctcagtgcatcgacagggaaggagcatcaatattgattcacggaacagaaggaactgattccacactccaggtgacctccttggcccagatcatcttagagccaagaagcaggaccattcgtggttttgaggccctgattgaaagagagtggctgcaggctggtcacccattccagcagcgctgtgcacagtcagcctactgtaacaccaagcagaagtgggaggctcctgtatttcttctcttcttggactgcgtgtggcagatccttcgtcagtttccctgttcttttgagtttaatgagaatttcctcatcatgctctttgagcatgcttatgcctcacagtttggaacatttctgggcaacaatgaaagtgaaagatgtaagttgaagctacagcagaagacgatgtctttgtggtcctgggttaatcagcccagtgagctgagtaaattcaccaatcccctctttgaagccaacaaccttgtcatctggccttcagttgctccgcagagtcttccactgtgggaaggtattttcctacgttggaatagatcctctaagtatttggatgaagcatatgaagaaatggttaacatcattgaatataataaagaattacaagcaaaagtcaatatccttcgaaggcagttggcagaactggaaacagaggacgggatgcaggagagtccctgaaaggtctcctcgcacccttcgcaaggaccttcttgggcctgtgtccgccgttctctccttgtgcccttcagttcacttttacacggtagccttgaagtgaaggctttagatgtgggacccccctaatgtaatggatttctcaatactgtatgaataatgaaacttactatcataaaccatgtttcatgtggcctgttagggcctgtcactttgggagccggaaggaggtgctagtcattttatttttacgtgaaatagatgacctatttaatgccatttgtgtttcatgccattttatccaaagctttttctctgtgtccactctccaaacagcattctagagcagtcaaggagacagctaatctctctagggactatttggtggtttaaaaaaagggtcagacttttaaacactctgaccatagaaatgtttttcaaaatggcaacaatggataaaccaaggattttgtgtttaacaatccatttccagtgtcttcgccacataaaatagccattttctttaaaatagttttggactaacgaagctgaaatctattctcattcttgtttgtcaagaaaggaaaatctgttattcaaggtaaattatttctacaagggcaacaggtatggtcctccgatatttacattaagaagagttaaatttattttaacgtagacactaaaagtatgtgcaatatacaattaaagtaggaatttgttactgattgagaattgttactggtgaattggttttcaggttttgagcatacatatacaatgtgtttcaaatgctgcttgtaaaattaaaccatcatctagaatagagttaatttattataatcaagctacaaataggttttcttaaaccagagatgcactgcccttgtctaaagttcttattgcactggtttatatgtgtatgtgtgttttattgtgtgtttttttaatttgtaagtattctaagagtttcctaatactaaggttaaaattttcatgttgacctgagccttttgcaaatttgctttggctctattgatttgtccattatgtgttaggcaaatataacttaagtggagggggaagtttatgaatataatatagctctgtgttttaaacctcagaaacagatttgagtgtttcagtattatagaaacagtgatgactattcatgctctgctagtctatgcctgcaactccaaatgtttgtggttcagtatttcccacctacatttctgtttggtgacattgctcattttaacaaatatgaccgagtctagtttttctttaaaaggatagtttatgagtaatctttaaaaccatttccataccatctgtatataaccatttcggtagagaacacactacactgaaccctgctttagagctgtgtgttgagctaaaaatataattttttaaaaattgactagcaaaatctatggccacactgagaagcctttgaaaatggcaaatacttttcatcaccaattgcccaattcatctttcttctgcttcctcagccttgtagcaaaggctacacagcagcccacagtccacagtctttttgggaaaattggcctgccaccttctttaagctcagtttatttttgacttactttctttgctgtagttatgaaccttggggcattaaaatcccatggcaaggagcataagagatgttctcgtagctctgcgttgtgtgaaatgtccatcttagttttgttaaaaaaaaaaaaaaaaaaaggaaacagcctcacttttttgtgctccctcagaattgcttgctatgtctgttaatacagctgagctttttgttttcttctctttttgtctcaagattgtatatgaaggaggcttttcttctcagctaacaggcatataaggaaaaccatctagagagttttctttagaagtgactcccattagcctggtgtggtggtgtgtgcctatagtcccagccactaggaaagctgaggcagaaggatcccttgagcctaggaggttgaggctgcagtgagctatgatcgcatcagtccactccagcctgagcaacagagcgagaccctgtgtctaagtaaagaaaaagccagaagtgactcccactgcttctgttgatcggccatagggcttccatgggtggaaacttgtgagggagtttgtattaggtctggtcatggagggatgatgtaccatcaaggtagacccatcttcctgatgcacatttgctgtgcgagccagagtacagtcataacacggtattcgcatttcgttttctctgtctcactgagacaacaatctatactgttttggcaagtttgcattttagtattaatttataattagggattgttcaaacttcagatctgtttacaggttgtaaaaataaacttcggtatcagtgcatctacagaagtgttatttggtaatccaaatattagagttttcccaaatccaaaaacggtcagaaataagtccattatcaatataatttgaagaagatttttagtagtactgtgaagttcgtgcttacctggatgagaagaataaatgacacggatacactcctgagaagacactcgttaaacattgcatcggagagctgcctttgataaatgtgctgttaaacacttgaatgaagagaatggtggcagaatgagtgagcaagcagattgccccagaggggccggtaataatcacgtgagggataatcagattcctgcgtattcagcatcttctctattcatgtggagtgaaagctggtttttatacaggagatacgtaaagtaggccccacaaataatatttttaaaatacaaaggatcaccacaatcctctattgaacatataaggatcctcagatttaaataagtactttttttttttttaatcagaagaacattgttgtttgattatatgtttttaaaaacctgaagcttttttggtggcaggacctttcaataaatatttatttggtcaaaattttttattttgattttattaaatgggaagaaagcaagcagaaatagtaaaattcagtaggtttaaaacaatctataaatgtattttatttccaagaaaacttagggtctcaaagcaagattttaaagtgatttttgagaagacttgggggggacaataatagacattcatgtcagatcccatatgggggatttttaaacatttctttgaactttgaggcctgatttaggggtgggattttattgctttttgttttaaaggatgaaattttgtggggttttagtctttgattcagtcagtatttggtttatgttaaataaaaaatcagtatcatggaaaagatatgaccataatttagtctcctcaagtgaaaaacaggagtaatgtttcgttgcactttgaaagatctgcttcaaggcataactcgtgtagttgtctggtttcagggatagctgtttgaattgtcattctaaagtaggtcatcaggttcacttattatccgaccttaatctgggataaaggttttggtatttgcccacttctagatagaatgaatgaaaacaacacaagcgttttatgagcactctttatcagaaaggtatttcctggaccagaaatgggcaatagttacaatagttgatcctctgttctggaagctttgaaatttatcagagaatgaagtcattcagtacatctgataaagttttgttgttgttgttgttgttgttgttttaattgggcaaccctcagaactgaagaggttcagagaactttccaggtttatactatacctcaagaccacatagattagctactgcttattctttcacatgggctaggcctgttctcctcctccagacctagtattctaagttattaccacatagtatttttatgttacccatcatctttaaaaacattataggctgggcatggtggcttacgcctgtaatcccagcactttgggaggccaaggcgggcggatcatgaggtcaggagatcgagaccatcctggctaacacggtgaaaacccatgtctactaaaaatacaaaaaattagccaggtgtggtggcgggcgcctgtagtcccagctactcaggaggctgaggcaggagaatggtgtgaacccgggaggcagagcttgcagtgagccgagatcgcaccactgcactccagcctgggcgaaagggcaagactccatctcaaaaaaaaaaaaaaaaaaagactcatttatccatttacatttattctcagatgataaaatatatactgatactataactttcttatggtatcagttttctttattttcttgaataaaattacttctaccttcatttggtctttataatccactgtccacagcatcttcctttaaaccaatagtcccagaagagaccctctgaaattctaggactggatattaaaatgcctgaacctgttatctaaatcctttttaagaaacttaatgttccagctcttgaactacactgtggaacagtaatttgtgcccaatttagtggaagataatgaggctcactgtaaacactacattgtcctgcaaagtaattctgatgagagtttactgacttctagagccattctctttaaccgtctgcaggtctaaggattaactatatttgtgatttgtaataaaactgagttgtacaacactgcctgtgtttgtctggccaagacatttgcttcacttttaaaatgcacgttatctttggagaggtgaattattctacaaaatgcaccctaaatctcattgtttaaaaccttactgatctaataccatctacacaaaaaaatgttgtagttgcagaacttagtttataaaaacaaagaatgtgtatttcttcaatagccgggtatttggattgttctcttgataatatttgaatgtgactcttggatttaagtgcactattattcatggcttatacaataaaattgcactgtatggcaaatatgtctataatgtatgctttgctgaaacctcaagagtgctgtaaggtacaggtttccatattgtgaacctgtgtacgcacacacacatatacatacagtcttagggaaaaaaaaaagcagaacttttgtaagtctgtgtaacattttaatattgtttgtaatattcactaggtgataatttcccctgtaccctataactgtaatcattcaccttgggttggccggtttgtcaagcttggtttactgaatcaagaaagagtcttgtcgaatgtggtactgttcttagtgtgtaatatttgcgtatggtgttcctctgcctcagaggacagttgcacagatggctagtgttaaatttctatagacgatggtaataaaatctgaatatatttaagtgctaataaattaaa

SEQ ID NO: 157132 - DNA, 1960 bp, Homo sapiens
  Payload ID: 10797
  Gene Symbol: MTMR9
  Gene Name: myotubularin related protein 9
  Uniprot ID: Q96QG7
  ENST ID: ENST00000526292
  CDS Start-End: 297-1691
tccgcagggagccgggggtcccttgtgggcgccccgggaaatacttcctggcgttttccgcgcagcctgccgcccagctagccggcaagatgagccctctgtggcctagaatcaggatttaccaagctgaaacccgtccagatggaggacccggtttccattaaacctggatggagttctcagggttatcgtgtggctggtaccatcctgatgatcatttctgatttgtaggatcactgggtaccatcatcataaaatgtaaagattttcgaattattcagttggatattcctggaatggaggaatgcttgaatatagccagttccattgaggcattgtctactctggactccatcactctgatgtaccctttcttttaccgtcctatgtttgaagtgatagaagatggctggcattccttccttcctgagcaagaatttgaactctattcttcagctaccagtgaatggaggctaagctatgtcaataaggaatttgctgtctgtccctcttacccaccaattgtcacagtgcccaaatccatcgatgatgaagctcttcggaaggtagctacatttcgacatggagggcgcttcccagtactaagctattaccacaaaaaaaatgggatggtaattatgcgaagtggtcagccactcactggtacaaacgggaggaggtgcaaggaggacgagaagctgataaatgctaccctcagggctggaaagcgtggctacatcattgacacccgatccctgaacgtggctcagcaaactagagccaaaggaggtggctttgaacaagaagctcattatcctcagtggaggcgaattcataagtccattgagaggtatcacattcttcaggagagcttaatcaaacttgtggaagcttgtaatgaccaaacacataacatggaccgatggctcagtaaattggaggcctctaactggctgactcacatcaaagagattctgacaactgcctgcctagcggctcagtgcatcgacagggaaggagcatcaatattgattcacggaacagaaggaactgattccacactccaggtgacctccttggcccagatcatcttagagccaagaagcaggaccattcgtggttttgaggccctgattgaaagagagtggctgcaggctggtcacccattccagcagcgctgtgcacagtcagcctactgtaacaccaagcagaagtgggaggctcctgtatttcttctcttcttggactgcgtgtggcagatccttcgtcagtttccctgttcttttgagtttaatgagaatttcctcatcatgctctttgagcatgcttatgcctcacagtttggaacatttctgggcaacaatgaaagtgaaagatgtaagttgaagctacagcagaagacgatgtctttgtggtcctgggttaatcagcccagtgagctgagtaaattcaccaatcccctctttgaagccaacaaccttgtcatctggccttcagttgctccgcagagtcttccactgtgggaaggtattttcctacgttggaatagatcctctaagtatttggatgaagcatatgaagaaatggttaacatcattgaatataataaagaattacaagcaaaagtcaatatccttcgaaggcagttggcagaactggaaacagaggacgggatgcaggagagtccctgaaaggtctcctcgcacccttcgcaaggaccttcttgggcctgtgtccgccgttctctccttgtgcccttcagttcacttttacacggtagccttgaagtgaaggctttagatgtgggacccccctaatgtaatggatttctcaatactgtatgaataatgaaacttactatcataaaccatgtttcatgtggcctgttagggcctgtcactttgggagccggaaggaggtgctagtcattttatttttacgtgaaatagatgacctattt

SEQ ID NO: 157133 - DNA, 3503 bp, Homo sapiens
  Payload ID: 10797
  Gene Symbol: MTMR9
  Gene Name: myotubularin related protein 9
  ENST ID: ENST00000530200
  CDS Start-End: 63-368
gcggcggggtaaccgcctcgcacctaccgggctcggttccctggctccggccgcgggggagcatggagtttgcggagctgattaagaccccgcgggtggacaatgtggtgctgcaccggcctttctacccggctgtcgagggcaccctgtgcctgacgggccaccacttgatcctgtcctcccggcaggacaatacggaggagctgtggctcctccattcaaacatcgacgccatcgacaagcgatttgtaggatcactgggtaccatcatcataaaatgtaaagattttcgaattattcagttggatattcctggaatggaggaatgcttgaatatagccagttccattgagaatccctcctgctagccctccacccttccccgaatacatctggacacgatttgcattgtctactctggactccatcactctgatgtaccctttcttttaccgtcctatgtttgaagtgatagaagatggctggcattccttccttcctgagcaagaatttgaactctattcttcagctaccagtgaatggaggctaagctatgtcaataaggaatttgctgtctgtccctcttacccaccaattgtcacagtgcccaaatccatcgatgatgaagctcttcggaaggtagctacatttcgacatggagggcgcttcccagtactaagctattaccacaaaaaaaatgggatggtaattatgcgaagtggtcagccactcactggtacaaacgggaggaggtgcaaggaggacgagaagctgataaatgctaccctcagggctggaaagcgtggctacatcattgacacccgatccctgaacgtggctcagcaaactagagccaaaggaggtggctttgaacaagaagctcattatcctcagtggaggcgaattcataagtccattgagaggtatcacattcttcaggagagcttaatcaaacttgtggaagcttgtaatgaccaaacacataacatggaccgatggctcagtaaattggaggcctctaactggctgactcacatcaaagagattctgacaactgcctgcctagcggctcagtgcatcgacagggaaggagcatcaatattgattcacggaacagaaggaactgattccacactccaggtgacctccttggcccagatcatcttagagccaagaagcaggaccattcgtggttttgaggccctgattgaaagagagtggctgcaggctggtcacccattccagcagcgctgtgcacagtcagcctactgtaacaccaagcagaagtgggaggctcctgtatttcttctcttcttggactgcgtgtggcagatccttcgtcagtttccctgttcttttgagtttaatgagaatttcctcatcatgctctttgagcatgcttatgcctcacagtttggaacatttctgggcaacaatgaaagtgaaagatgtaagttgaagctacagcagaagacgatgtctttgtggtcctgggttaatcagcccagtgagctgagtaaattcaccaatcccctctttgaagccaacaaccttgtcatctggccttcagttgctccgcagagtcttccactgtgggaaggtattttcctacgttggaatagatcctctaagtatttggatgaagcatatgaagaaatggttaacatcattgaatataataaagaattacaagcaaaagtcaatatccttcgaaggcagttggcagaactggaaacagaggacgggatgcaggagagtccctgaaaggtctcctcgcacccttcgcaaggaccttcttgggcctgtgtccgccgttctctccttgtgcccttcagttcacttttacacggtagccttgaagtgaaggctttagatgtgggacccccctaatgtaatggatttctcaatactgtatgaataatgaaacttactatcataaaccatgtttcatgtggcctgttagggcctgtcactttgggagccggaaggaggtgctagtcattttatttttacgtgaaatagatgacctatttaatgccatttgtgtttcatgccattttatccaaagctttttctctgtgtccactctccaaacagcattctagagcagtcaaggagacagctaatctctctagggactatttggtggtttaaaaaaagggtcagacttttaaacactctgaccatagaaatgtttttcaaaatggcaacaatggataaaccaaggattttgtgtttaacaatccatttccagtgtcttcgccacataaaatagccattttctttaaaatagttttggactaacgaagctgaaatctattctcattcttgtttgtcaagaaaggaaaatctgttattcaaggtaaattatttctacaagggcaacaggtatggtcctccgatatttacattaagaagagttaaatttattttaacgtagacactaaaagtatgtgcaatatacaattaaagtaggaatttgttactgattgagaattgttactggtgaattggttttcaggttttgagcatacatatacaatgtgtttcaaatgctgcttgtaaaattaaaccatcatctagaatagagttaatttattataatcaagctacaaataggttttcttaaaccagagatgcactgcccttgtctaaagttcttattgcactggtttatatgtgtatgtgtgttttattgtgtgtttttttaatttgtaagtattctaagagtttcctaatactaaggttaaaattttcatgttgacctgagccttttgcaaatttgctttggctctattgatttgtccattatgtgttaggcaaatataacttaagtggagggggaagtttatgaatataatatagctctgtgttttaaacctcagaaacagatttgagtgtttcagtattatagaaacagtgatgactattcatgctctgctagtctatgcctgcaactccaaatgtttgtggttcagtatttcccacctacatttctgtttggtgacattgctcattttaacaaatatgaccgagtctagtttttctttaaaaggatagtttatgagtaatctttaaaaccatttccataccatctgtatataaccatttcggtagagaacacactacactgaaccctgctttagagctgtgtgttgagctaaaaatataattttttaaaaattgactagcaaaatctatggccacactgagaagcctttgaaaatggcaaatacttttcatcaccaattgcccaattcatctttcttctgcttcctcagccttgtagcaaaggctacacagcagcccacagtccacagtctttttgggaaaattggcctgccaccttctttaagctcagtttatttttgacttactttctttgctgtagttatgaaccttggggcattaaaatcccatggcaaggagcataagagatgttctcgtagctctgcgttgtgtgaaatgtccatcttagttttgttaaaaaaaaaaaaaaaaaa

SEQ ID NO: 157134 - DNA, 1541 bp, Homo sapiens
  Payload ID: 10798
  Gene Symbol: MYOZ1
  Gene Name: myozenin 1
  Uniprot ID: Q9NP98
  ENST ID: ENST00000359322
  CDS Start-End: 366-1265
gtttctccctaagtgcttctttggatctcaggctctaggtgcaatgtgaaggggagtccctgggcagactgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggctgaatccacctccacaatgccgctctcaggaaccccggcccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaa

SEQ ID NO: 157135 - DNA, 2597 bp, Homo sapiens
  Payload ID: 10799
  Gene Symbol: MYOZ2
  Gene Name: myozenin 2
  Uniprot ID: Q9NPC6
  ENST ID: ENST00000307128
  CDS Start-End: 214-1008
atatagccagttgatgtcagctgaatgccagtctcttcagaaaagctcagtccccagtttgagtcagagtagggaccatgctgtcccaggttcaaggataaaaaccatcaggcccaagtgccatccatagtccatctccagagtcttcctccacaaactgggattcatccccgctgaaaaagcacaatctaacagcaagggaacaaaaaaaccatgctatcacataatactatgatgaagcagagaaaacagcaagcaacagccatcatgaaggaagtccatggaaatgatgttgatggcatggacctgggcaaaaaggtcagcatccccagagacatcatgttggaagaattatcccatctcagtaaccgtggtgccaggctatttaagatgcgtcaaagaagatctgacaaatacacatttgaaaatttccagtatcaatctagagcacaaataaatcacagtattgctatgcagaatgggaaagtggatggaagtaacttggaaggtggttcgcagcaagcccccttgactcctcccaacaccccagatccacgaagccctccaaatccagacaacattgctccaggatattctggaccactgaaggaaattcctcctgaaaaattcaacaccacagctgtccctaagtactatcaatctccctgggaacaagccattagcaatgatccggagcttttagaggctttatatcctaaacttttcaagcctgaaggaaaggcagaactgcctgattacaggagctttaacagggttgccacaccatttggaggttttgaaaaagcatcaagaatggttaaatttaaagttccagattttgagctactattgctaacagatcccaggtttatgtcctttgtcaatcccctttctggcagacggtcctttaataggactcctaagggatggatatctgagaatattcctatagtgataacaaccgaacctacagatgataccactgtaccagaatcagaagacctatgaaaagaaagttgtatgtgccacataaaactctgaatataaaagttgctgttctactattttaactactggcaaagccacttgcatttttcattagtagcaacaatagcaatttagtgattttccttttctgacattcaatttcaatctcagatcaaatactaataaacaattagaaatcttactttaaaaaacttataactcacttgtcttcattcataattttgttttcacctggtttaaagaatccagatattttactgcaaaagttcagatggaaaagtaattgacagtttcacctttgtctcattttatatgatttattacagtgtaagtttttcaagtggaatctagaatcaaaatacagggagagatatgaagacctattcagagtttcatctggggatgaaagctatggaagatgatgtacaaatgttattgatggagaaaatggttgggtgtgtcctttctggtgaccatgagaaaataatatgtcttgatgaagtcttttcattagtcactcttagaattctaaagtgctttgcacttttcaatatgttttgaatcattaggtaatttattctggatgatattctccaaaattcaattcagttattatattcatttagcattaagtcaaggagactgagaatgactcaagggacgtcatagtaccatagttttaaggaccaaggtgtgcccagaattcaagtttcacaaatcccaatgctgtgcattgattatgttcaactttatgtgtgcattcttagaagagtaagaacaaataaagtacaccgtaatatacatataaatacattcatgtttgtgagagaaggaaagagtaagtaatttgaattggcagctttctttgctaaatctttaaattctgttaagatcctcaagtaactggggagtacatgctttaggacacaaacaaaaacaaagggcatgaaagtatctgaaagcaatgtagcacatatctatcgtaatatatgtaatatattgacataaaagacacaaactaatataaagttatagttatatcttaaaatataattgaagaagcatatgacatataacttatagaaatcagtatcaattcctcccatttcaattcagttaagacttctgtgatagatgtttatagcagagaagaaatgtctcatcaatagaaaactatcagataaagtttaggagataggaagaaggactgtgtgtagtaatgaaaataccaagttgcaacattacatgtttacaaaaaaaaatctgtgtttgtagtgtggaagttggtgactgttttaatcatcatctagacttgttaagtagaaaaattttaaaaatttgcttatgaaaatataacccccagaaagtaacaatgacaaagtattatatttatatatattattgtagagaatttgtatatttttaaagatgtcttaagatatcttaattttatttataagttttggtgtttacctgttttaaaatgataatgttggcatctgtgataaactatcaatgaggctcccatcatgccattttttgttcattttaatctttaaaaaataaaaattaggcatattaattatgca

SEQ ID NO: 157136 - DNA, 3445 bp, Homo sapiens
  Payload ID: 10800
  Gene Symbol: MYOZ3
  Gene Name: myozenin 3
  Uniprot ID: Q8TDC0
  ENST ID: ENST00000297130
  CDS Start-End: 200-955
caggagagaagaaaggaaggaagaaaaggataagtcaagcaaagatattgaggagcaattcattcatccatctatctatccatccattccttccttcgacaaatatctgctgagttcctatcaagcaccattcttggcactaaggatataacagttaacaagcggaagctaccagcagctgaccctcaacatttccaggatgatccccaaggagcagaaggggccagtgatggctgccatgggggacctcactgaaccagtccctacgctggacctgggcaagaagctgagcgtgccccaggacctgatgatggaggagctgtcactacgcaacaacagagggtccctcctcttccagaagaggcagcgccgtgtgcagaagttcactttcgagttagcagccagccagcgggcgatgctggccggaagcgccaggaggaaggtgactggaacagcggagtcggggacggttgccaatgccaatggccctgaggggccgaactaccgctcggagctccacatcttcccggcctcacccggggcctcactcgggggtcccgagggcgcccaccctgcagccgcccctgctgggtgcgtccccagccccagcgccctggcgccaggctatgcggagccgctgaagggcgtcccgccagagaagttcaaccacaccgccatctccaagggctaccgctgcccttggcaggagttcgtcagctaccgggactaccagagcgatggccgaagtcacacccccagccccaacgactaccgaaatttcaacaagaccccggtgccatttggaggacccctcgtggggggcacttttcccaggccaggcacccccttcatcccggagcccctcagtggcttggaactcctccgtctcagacccagcttcaacagagtggcccagggctgggtccgtaacctcccagagtccgaggagctgtagccctagcctgaatcttcagttccccagtctcgggggcctggtaacatccggagccaagacttgtggacagcacttcacagttgaagaagggccttcacacacaaaacctgattgcaaatggcttcagaggtcaccaagttcagtcgtcccaaaacatgggtgtgtttcaaaattacctggggatgttgttccaaatccagacaactggactgtcccagacttgcagcatcagagtctcctgagtcgaggaatctgtattattaatagcaaccagggccgggtgtcgtggctcacgcctgtcatcccagcactttgggaggccgaggcaggaggatcacctgaggtcaggagtttgagaccagtctggccaaaatagtggaaccccgtcgctactaaaaatacaaaaatgagtcggacatggtggtgcatgcctgtaatcccagctacttgggaggctgagacaggagaatcacttgaactaggaggcagaggttgcagtgagccgagattgcgccactgcaccccagcctggacaacagagtgagactccttctcaaaagtaaataaataaatagcaaccagtactccaggtgattccagcataacttatccatggtttgtgtcattaggagtccacatccacacctctgctctttcctgttcctgtagtgtacactcccccggtgacagggtgctcactggcaccccatcttcctgtgaataactcaaataattagaaaatgttccttttactgagatgcagttggtcttcatctattcatgctctaaacagttcctaagcgctgactgtgcgctagacactgccaggcccgggcctcgaggaggaaaagacagtagggaagacattatagagcatgaagtcaccataattttccctaaagcatgcttattgacaattgaggaacaaagtgttgtggagcagaagaaggagtccctcaccctaggtgtgagatgggattctggaagcttcctgaaggatttgagtgggaccttgtgggaggcgtgagagtccatgaagggggtgtgagggggagggtatttctggaaagtggaccagcatgtgcaaaaatatggaactgagcacgggtgcagggtgttctgcagaagggagaaggctgtgctagaggagccagtgagggccagcatggggtgggcttcactaaggaaatggggaaggttttagtgatgggtcttgctgggtgctgtgtggggcgcatattggagaagggtaatgccagaagccaggaagcctgcaagggatgaggccatgggaatggagagaaggggccacccactgggcacctaacaggacaggtgcaaagtggggtgcttattaagattccttctttccactccattttgagcaggctgcttaaagtggtggtgatgatgatgatgatgatggcagctttatatcgagtgcctcagtgcttgggctggtagtagtttctctacatatcttatttctaattctcagaacaaccctgagagaaagatattgttgtccccactttacagatgtggatatttaggccaaaaggaggaagtgacttgtccaggggcagacaccaaatgggaatctgattccagtggatgtctcttttcagtgcactgggtggtcaatgcccactcgctctgaaatcatctgactgtgatgccctgccttggagtttagaagttgagtgcaggcttgggagtcagactggatggggtaggttctaactctgccactgctagccggatgaacttgagcaagtcatttcacatctccgagcctctgtttctccaagtgtaagatgaggacaagtataaaacctcctttatgggtttgttgtgaacacagtgcagggcacatttataataagagctcagtcaatggtaggtttcatgcaactgctgctctaggctggaaaagttgttcttgcactggatgcagcatgagaagctggctgctaagatgtcactgggggtcactaaagctgaagcctgaaggaaagcctctcattgctgtagagctctccctgcctctctctctgggggcgatggggaaggtcaggagtccagcccattcccagggtgtgtgggatagcgattgcattttccttttgctctggagtttcactccccttctgggtcccaagggcccaatggcctgacttttagaattgcttgcaattggtgttttctcttgaatttgggggctgccatttaaagccaggtttccatgagctgaagaccagccattcaagaatctgaaaagtagacaagaggactccagttgcctcaggttggttctgctgtgctctggaaagtaactgcagccaccaggtatgaaaaggagcctggtggggagaccactgcacccaaaacaaatcctttcttcttctgagaatgtgactttttctggtgttgtaaaaaagaaaaaaaaaagaatgctcattgtaaaaataaaaaaataataataagcaa

SEQ ID NO: 157137 - DNA, 1451 bp, Homo sapiens
  Payload ID: 10800
  Gene Symbol: MYOZ3
  Gene Name: myozenin 3
  Uniprot ID: Q8TDC0
  ENST ID: ENST00000517768
  CDS Start-End: 556-1311
aagaaaggcaggagagaagaaaggaaggaagaaaaggataagtcaagcaaagatattgaggagcaattcattcatccatctatctatccatccattccttccttcgacaaatatctgctgagttcctatcaagcaccattcttggcactaaggatataacagttaacaagcggaagctaccagcagctgaccctcaacatttccaggtgactttggtgtgtgcatatgtgagtgtgtgtgtacacgtgggtgcaagccctctgtctgcacaggcctgttgccagggcacctgtcttccctagggtctggtgcttttagcctctggctccagctcctattgcagcccgaaataaggctgtgacccatggcaaggcaggaatgattctcatcagctgaagccagagctggctgcaggggacaccctgctcgctgcctactgactgctgaccgctgactgcctacagggacgccacgcaactctcagcttcccgacagaggtgttaatcttgagggtctaagattccctcctgcctattgtggtcccatcctctcaggatgatccccaaggagcagaaggggccagtgatggctgccatgggggacctcactgaaccagtccctacgctggacctgggcaagaagctgagcgtgccccaggacctgatgatggaggagctgtcactacgcaacaacagagggtccctcctcttccagaagaggcagcgccgtgtgcagaagttcactttcgagttagcagccagccagcgggcgatgctggccggaagcgccaggaggaaggtgactggaacagcggagtcggggacggttgccaatgccaatggccctgaggggccgaactaccgctcggagctccacatcttcccggcctcacccggggcctcactcgggggtcccgagggcgcccaccctgcagccgcccctgctgggtgcgtccccagccccagcgccctggcgccaggctatgcggagccgctgaagggcgtcccgccagagaagttcaaccacaccgccatctccaagggctaccgctgcccttggcaggagttcgtcagctaccgggactaccagagcgatggccgaagtcacacccccagccccaacgactaccgaaatttcaacaagaccccggtgccatttggaggacccctcgtggggggcacttttcccaggccaggcacccccttcatcccggagcccctcagtggcttggaactcctccgtctcagacccagcttcaacagagtggcccagggctgggtccgtaacctcccagagtccgaggagctgtagccctagcctgaatcttcagttccccagtctcgggggcctggtaacatccggagccaagacttgtggacagcacttcacagttgaagaagggccttcacacacaaaacctgattgcaaatggcttcagaggtcaccaagtt

SEQ ID NO: 157138 - DNA, 605 bp, Homo sapiens
  Payload ID: 10800
  Gene Symbol: MYOZ3
  Gene Name: myozenin 3
  ENST ID: ENST00000520112
  CDS Start-End: 111-590
gagccggaggggcgccgcgccccaggtcacacagcgagtcagccaaggccaagaccaacccgcgctgcgaactcgtggcttcctcactgcagtcctccgtgtttcctgggatggggaggggtctcctgtgctggagcaactgtggcttcccattcccgccgtcctctcccctaactccgatcttccctcctccaaccgcgtccgcggaatgggggtggggcgaggtggggttgggggctgagggtggaagaacggaggcgctcccttccccccgcgcccctaggctatgcggagccgctgaagggcgtcccgccagagaagttcaaccacaccgccatctccaagggctaccgctgcccttggcaggagttcgtcagctaccgggactaccagagcgatggccgaagtcacacccccagccccaacgactaccgaaatttcaacaagaccccggtgccatttggaggacccctcgtggggggcacttttcccaggccaggcacccccttcatcccggagcccctcagtggcttggaactcctccgtctcagacccagcttcaacagagtggcccagggctgggtccgtaacctcccagagtccga

SEQ ID NO: 157139 - DNA, 576 bp, Homo sapiens
  Payload ID: 10800
  Gene Symbol: MYOZ3
  Gene Name: myozenin 3
  ENST ID: ENST00000523553
  CDS Start-End: 1-315
aatgccaatggccctgaggggccgaactaccgctcggagctccacatcttcccggcctcacccggggcctcactcgggggtcccgagggcgcccaccctgcagccgcccctgctgggtgcgtccccagccccagcgccctggcgccaggctatgcggagccgctgaagggcgtcccgccagagaagttcaaccacaccgccatctccaagggctaccgctgcccttggcaggagttcgtcagctaccgggactaccagagcgatggccgaagtcacacccccagccccaacgactaccgaaatttcaacaagtaaggcggggcgggcagcccgggggacagaccgggaggggcgggaagccagtcacagccacagcgggagcctgcgtttcctgagcactttctgcaggccaggctctgtccccagcgctttctattcattgactgagctctggctggaacagcgcctccgcacctggtaggtgctcagttaacgtgggagaaatgaagagtgaaggtgccgcacatcttggatattctccaggacatggtgggcgggtgctatgagttttcctgt

SEQ ID NO: 157140 - DNA, 1031 bp, Homo sapiens
  Payload ID: 10800
  Gene Symbol: MYOZ3
  Gene Name: myozenin 3
  Uniprot ID: Q8TDC0
  ENST ID: ENST00000615557
  CDS Start-End: 556-819
caaaaatttgttcacttggaaatgtggagatctttaacttgtaaagatcttgataaaacaagttacaggccgtgagccaccgcgcctggcccatatatgcttttttataataataaaaggctattttaaagttaaaagaacacaggtctaaaactgaactcctgatctttcccagaaccttctcctccctttgccttccccatctccgtgaatggctgctctatccttccagtggctaaggccagaaaccttgcagtcatcctctctcactcattgcccatacccatggcttacctttaaaaaatatcgagaatctgaccatttctcactacctccaccattatgggcaaagacctgcatggggaattcatgcaataaacacaaatggccaaagaacttcggaaacagtgctaaacttcactgagcaacaaacacatgcaaattaaactctgaggtgtcatttttgcccatcaggtgggcaaagatttcaaacaatcatgacacccggtgtcggcaagcttggtgagaaacaggcattcttacacacagcatgccatgcttcgagaggtggggcctggagtgtatgggggatggggtggtgagagcccgctctggcctttcctggcagtccctacgctggacctgggcaagaagctgagcgtgccccaggacctgatgatggaggagctgtcactacgcaacaacagagggtccctcctcttccagaagaggcagcgccgtgtgcagaagttcactttcgagttagcagccagccagcgggcggtgagtaagccaccattgtgctcatggggaaaatgaggaccacagagagccactggttagcctaaagtcaaacggtaagccaggctgaggactgtgatgttcccatcagattaggctcctgcctttcagtgtgatccttgaaaagtgttatctttttaggcatctctccctggatacagaacaaagtaaacaaagtggattagggggttgaggataagccgtggagtgaagggactctggctcctacc

SEQ ID NO: 157141 - DNA, 4275 bp, Homo sapiens
  Payload ID: 10801
  Gene Symbol: MARCKS
  Gene Name: myristoylated alanine-rich protein kinase C substrate
  Uniprot ID: P29966
  ENST ID: ENST00000612661
  CDS Start-End: 385-1383
cccgcatcttattagcaaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgatggggtcacaatggggaaattgaagtggtgcataacattgccaaaatagtgtgccactagaaatggtgtaaaggctgtcttttttttttttttaaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgtacaaatttgttgtgtttttttatgttctaataatactgagacttctaggtcttaggttaatttttaggaagatcttgcatgccatcaggagtaaattttattgtggttcttaatctgaagttttcaagctctgaaattcataatccgcagtgtcagattacgtagaggaagatcttacaacatttccatgtcaaatctgttaccatttattggcatttagttttcatttaagaattgaacataattatttttattgtagctatatagcatgtcagattaaatcatttacaacaaaaggggtgtgaacctaagactatttaaatgtcttatgagaaaatttcataaagccattctcttgtcattcaggtccagaaacaaattttaaactgagtgagagtctatagaatccatactgcagatgggtcatgaaatgtgaccaaatgtgtttcaaaaattgatggtgtattacctgctattgtaattgcttagtgcttggctaatttccaaattattgcataatatgttctaccttaagaaaacaggtttatgtaacaaagtaatggtgttgaatggatgatgtcagttcatgggcctttagcatagttttaagcatccttttttttttttttttttgaaagtgtgttagcatcttgttactcaaaggataagacagacaataatacttcactgaatcttaataatctttactagtttacctcctctgctctttgccacccgataactggatatcttttccttcaaaggaccctaaactgattgaaatttaagatatgtatcaaaaacattatttcatttaatgcacatctgttttgctgtttttgagcagtgtgcagtttagggttcatgataaatcattgaaccacatgtgtaacaactgaatgccaaatcttaaactcattagaaaaataacaaattaggttttgacacgcattcttaattggaataatggatcaaaaatagtggttcatgaccttaccaaacacccttgctactaataaaatcaaataacacttagaagggtatgtatttttagttagggtttcttgatcttggaggatgtttgaaagttaaaaattgaatttggtaaccaaaggactgatttatgggtctttcctatcttaaccaacgttttcttagttacctagatggccaagtacagtgcctggtatgtagtaagactcagtaaaaaagtggatttttaaaaataactcccaaagtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatgaaatttgacgtatcttttcatccaaagttttgtacatcatgttttctaacggaaaaaaatgttaatatggcttttttgtattactaaaaatagctttgagattaaggaaaaataaataactcttgtacagttcagtattgtctattaaatctgtattggcagtatgtataatggcatttgctgtggttacaaaatacttcctctgggttataataatcatttgatccaattcctattgcttgtaaaataaagttttaccagttgatataa

SEQ ID NO: 157142 - DNA, 1868 bp, Homo sapiens
  Payload ID: 10801
  Gene Symbol: MARCKS
  Gene Name: myristoylated alanine-rich protein kinase C substrate
  ENST ID: ENST00000617290
  CDS Start-End: 309-1301
tttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctccgcggccgagaaaggtgagccggccgccgccgctgcccccgaggccggggccagcccggtagagaaggaggcccccgcggaaggcgaggctgccgagcccggctcgcccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggccggcgcgcccccggagcggaggcagcccccgcggaggagcccgcggccgccgcagcctcgtcagcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactggttttggagaacttgtctacaaccagggattgattttaaagatgtctttttttattttacttttttttaagcaccaaattttgttgttttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgatggggtcacaatggggaaattgaagtggtgcataacattgccaaaatagtgtgccactagaaatggtgtaaaggctgtcttttttttttttttaaaagaaaagttattaccatgtattttgtgaggcaggtttacaacactacaagtcttg

SEQ ID NO: 157143 - DNA, 1525 bp, Homo sapiens
  Payload ID: 10802
  Gene Symbol: MEAF6
  Gene Name: MYST/Esa1-associated factor 6
  Uniprot ID: Q9HAF1
  ENST ID: ENST00000296214
  CDS Start-End: 29-604
gcgccgccgccgcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatgaagacaatgttgtaatcccagcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatca

SEQ ID NO: 157144 - DNA, 603 bp, Homo sapiens
  Payload ID: 10802
  Gene Symbol: MEAF6
  Gene Name: MYST/Esa1-associated factor 6
  Uniprot ID: Q9HAF1
  ENST ID: ENST00000373073
  CDS Start-End: 18-596
gcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagaatgaatgtctcccccaaaactggctggcaccagcttcatctgtgataccctt

SEQ ID NO: 157145 - DNA, 2005 bp, Homo sapiens
  Payload ID: 10802
  Gene Symbol: MEAF6
  Gene Name: MYST/Esa1-associated factor 6
  ENST ID: ENST00000373074
  CDS Start-End: 708-1217
agggggacccagtcaccccgtctggactttggaggctggtggggagcgtgttctttttggtactgggagtagatccgttgaatggaggtttttgatagacagggttgtgatgtgtttgggaacatctagaaggtgacaggcgagggagaagaacacattccggagaattcagaattgtgacaggcacccaaggcccaatgcactctggtggctaagctcttcctgcccccgcgtctcggcttgggcacccgggaggcccctctcacctgaagctgcccttctaggtttccatagcaactggcagcccggtgtcggcggcctctcttgagcctgcggggaggggagcgagttgacgctgaaaggctgctcacctttccctctcctggtagcgataccttttgtgcgtgggagtggacatcgcccaagttctgcgttagcctgggctcttgactcatggtttccgtgaatcctctaaagtatatgcaaaatttcgcgtgtgtgtgtatttttctggagacatgctttatacattcaggggtccatcacccccaaaggtctagactgtcttagtcctaaacggctcctcctccccgtatcttccatctctccacagggtggtttagtgtgggcaagcttgcgtttacgagtctaatatcaggatttcattttggccagacttaagtgtttgcatttaaaaggtatcattcatgtccttgtttttcatctctcaggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatgaagacaatgttgtaatcccagcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaa

SEQ ID NO: 157146 - DNA, 2147 bp, Homo sapiens
  Payload ID: 10802
  Gene Symbol: MEAF6
  Gene Name: MYST/Esa1-associated factor 6
  Uniprot ID: Q9HAF1
  ENST ID: ENST00000373075
  CDS Start-End: 18-623
gcccgcctcagcccaacatggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattagaagacacattagtgcagaagcttccaggctgtagagccctgcttcccttctctgacctcacaaagataaacatccttcacctgagttcgtggccatccacctctgctctcccagacccagtgcctgtgactttgagtagtttgttctaaatgtggtgacaaacaagtcatttctgtaagacattgggtcttactttatgtcatttttagtaacagaactgcaggaagatgaagacaatgttgtaatcccagcaagttgctaactgtgcgtttctcccttcttagaatgaatgtctcccccaaaactggctggcaccagcttcatctgtgatacccttcaagaaatgttctctggttttgttttatgctgaaagtagaacacaagtcacatttcagatggaggctgtaaatatctggcattttcttatattgttttatgttttcttgtttttctcttgttgtttttatcttattttctttggggtttttttgtaatgcctttgtacagctcatactttcctgctgacatatctgatcatctctttcatgcagttgccaatattcataactgaaaataatctggtttatcataagtaaaatgggaaacttgcctctgttttttgcaaggggaggtaaagagtgtttagtaattacctatcttaaatctttctgagttggtagtagattcatgttcaaggaacaggaaaaatggaaaaacataagtttaaatcagttctttttaaataactttttattcttttgtataaataaaatttcacaggcttcaaattctcatgctttacttttaaacccgagattgttttttcacttatttattcatatcatgccttatggaaatttctttttctgtattttctctctttgctggtattcacctgattaaatattgctctaaaaatcaccatggcatatggaaagtctcaaaattataccaaaagtgataacttatgtcgttcttaagtggagtgaaaggatagcatcagtgagagccagtgttgcccaccaggtctccctttcttggagggcttgttggggctgaggaatctgctagtaatcgttacctgcctctagtgctgtggtgaacttgcgacagggtctggctgcacattggaatcacctgagaagctttaaaatactcatgcctggatcccatccctagagactggggtacagcctagttattgggaatttctttaaaagagttcctgggattctgataagaagccaggttgagaaccactacattagaagactgaatggtttaatttacatcctatgttatgattggtctaagggataagatttggggtctaacctttcctttcactctagttagtcatagtccttgacttatgcctatatctttgtaagaaatagtatgtttcatttgtgatagtattggtagggctgaatatggatggcatctactgtaaaacaagtctaccttgtcagatgtgcaaaagctttcactcttgttctcaaataaacttttgtgggttttttt

SEQ ID NO: 157147 - DNA, 666 bp, Homo sapiens
  Payload ID: 10802
  Gene Symbol: MEAF6
  Gene Name: MYST/Esa1-associated factor 6
  Uniprot ID: Q9HAF1
  ENST ID: ENST00000448519
  CDS Start-End: 1-576
atggcgatgcacaacaaggcggcgccgccgcagatcccggacacccggcgggagctggcggagctcgtgaagcggaagcaggagctggcggaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagtatgtatattaggttaggctgggaagttttttttaaaaacagaaaaacgtgatggaggattgatctgaagttaaacaaaaaaccacgagctgtaagtatcag

SEQ ID NO: 157148 - DNA, 837 bp, Homo sapiens
  Payload ID: 10803
  Gene Symbol: NAA10
  Gene Name: N(alpha)-acetyltransferase 10, NatA catalytic subunit
  Uniprot ID: P41227
  ENST ID: ENST00000370009
  CDS Start-End: 112-774
agcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagaggatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggg

SEQ ID NO: 157149 - DNA, 538 bp, Homo sapiens
  Payload ID: 10803
  Gene Symbol: NAA10
  Gene Name: N(alpha)-acetyltransferase 10, NatA catalytic subunit
  ENST ID: ENST00000370011
  CDS Start-End: 112-538
agcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtgggggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagaggatcagtgaagtggagcccaaatactatgcagatggggaggacgcctatgccatgaagcgggacctcactcagatggccgacgagctgaggcggcacctggagc

SEQ ID NO: 157150 - DNA, 1002 bp, Homo sapiens
  Payload ID: 10803
  Gene Symbol: NAA10
  Gene Name: N(alpha)-acetyltransferase 10, NatA catalytic subunit
  ENST ID: ENST00000370015
  CDS Start-End: 138-647
gcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtg

SEQ ID NO: 157151 - DNA, 908 bp, Homo sapiens
  Payload ID: 10803
  Gene Symbol: NAA10
  Gene Name: N(alpha)-acetyltransferase 10, NatA catalytic subunit
  ENST ID: ENST00000393712
  CDS Start-End: 55-609
ggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaa

SEQ ID NO: 157152 - DNA, 599 bp, Homo sapiens
  Payload ID: 10803
  Gene Symbol: NAA10
  Gene Name: N(alpha)-acetyltransferase 10, NatA catalytic subunit
  ENST ID: ENST00000432089
  CDS Start-End: 163-599
acttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtgggggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcac

SEQ ID NO: 157153 - DNA, 1772 bp, Homo sapiens
  Payload ID: 10803
  Gene Symbol: NAA10
  Gene Name: N(alpha)-acetyltransferase 10, NatA catalytic subunit
  Uniprot ID: P41227
  ENST ID: ENST00000464845
  CDS Start-End: 320-1027
cgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgaggccagaggacctaatgaacatgcagcactgcaacctcctctgcctgcccgagaactaccagatgaaatactacttctaccatggcctttcctggccccagctctcttacattgctgaggacgagaatgggaagattgtggggtatgtcctggccaaaatggaagaggacccagatgatgtgccccatggacatatcacctcattggctgtgaagcgttcccaccggcgcctcggtctggctcagaaactgatggaccaggcctctcgagccatgatagagaacttcaatgccaaatatgtctccctgcatgtcaggaagagtaaccgggccgccctgcacctctattccaacaccctcaactttcagatcagtgaagtggagcccaaatactatgcagatggggaggacgcctatgccatgaagcgggacctcactcagatggccgacgagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcgggctacagcagctccccagcatacccgtgggctccagatgtggacatccaactgctcattgggcttatctacaaatgtcctgtctgagtaatgacccagccagatgccccatcaacagtccttgagtcctccctcccctgccaccctaatggtcagtgagtccatgatacctcttgagtctactccctaacctgagtttgcatttgaaaataatttatttttagtacaattccccgcgtttccccattgacattttgtattagttggtgtatttgttattgttgatgcgccaatactgataagttattgtaaactaca

SEQ ID NO: 157154 - DNA, 2014 bp, Homo sapiens
  Payload ID: 10804
  Gene Symbol: NAA11
  Gene Name: N(alpha)-acetyltransferase 11, NatA catalytic subunit
  Uniprot ID: Q9BSU3
  ENST ID: ENST00000286794
  CDS Start-End: 174-863
atcttttccatctcctgctccttccgccttcccgccatccgccctccacacgattcagcccggtggtgttagccccctggactcgattcctgaggcaaacagtgccccttaaggtcggcgacagcctcttctgggttcactgcagtccaaccggttccctaccctctgccattatgaacatccgcaacgctcagccagacgacctgatgaatatgcaacactgcaacctcctttgccttcctgagaactaccagatgaaatactatttatatcatggcctttcctggccccagctttcttacatcgctgaggatgaggacgggaagattgtgggctatgttctggccaaaatggaggaggaaccagatgatgtcccgcatggccatatcacctcactggccgtgaagcgttcacaccggcgcctcggcctggcccagaagctgatggaccaggcctccagggccatgatagagaactttaacgccaaatacgtgtctctgcacgtcaggaagagtaaccggccagccttgcacctttattctaacaccctcaactttcagattagtgaggtggaacctaaatactatgcagatggggaagatgcttatgctatgaagcgggatctctcgcagatggcagatgagctgagacgacaaatggacctgaagaagggcgggtatgtggtcctgggctccagggagaaccaggagacccagggcagcacactttctgattctgaagaggcctgtcagcaaaagaacccggctaccgaagaaagtggcagtgacagcaaagaacctaaggagtctgtggagagcaccaacgtccaggacagctcagaaagctcggattccacctcctagagcatgcttaagcatttcaggtcctcatgtctcaaccacatctactctgtgaaccctggcttagtctgtctgctctgcagcatctgctgtggggatcatctcacagtgaccagaatggcttctcactcttaactctataaacaaccacctttcacatatcctgctgggatcatgaaggaatacctggacacaagagccactgcacaacagccaaggaactttgagacctgccattacagaacctttcttggcctactcacactacgctgccattttattctgtttgtagtagtcctctgttgggtgtggttatcctgcaagtttttctccttttagaatgatgaacaggaagcagggcaaactcttgaagatttccagctttcagtttttgtttttgttttttaaccattatttacctgagttttcatccttgaggaggtgaagtagtcaggaccatgaagtcagacctcatgccctcttcctcctctttcctggaagaagtattcagtttccttttcctttctctggtaactcctcctttatactattcccccctcccttttttttgaggaggagggcatcaccttcccagtgggaaaaggtgttaagttaggagcttctactgtacaatcagaacttggagattttaagaaaaggacaaacggtaattaaattggaatctctaatgtgcttgtttgtgttagtttttttgtgattatgtcacttggcatttattgagtacctgcagtgttcacacacaatgctggagccttcattagttacatatttaaccctctcagcaaccctgtaaagtaggtagtattatccctgttttacagatgaggaaactgaagctcagagaagtgaattaaatatcctggatctgaacccaattctgtttgaattcaaagccaaagttccttctacttttctgttcctactctttgcattttatttataaatgtgttaaaattttagcaaaaatggagaatctgctgtttaaaaatgtgtttgcttaatacatggctactgtatgtcaattgtaaatatttatataacctacaattataatctatttttattatttttctctagtaaaaataagtgaagacaaagtaccttgacctctgcagtaaaagttaccagataaa

SEQ ID NO: 157155 - DNA, 1035 bp, Homo sapiens
  Payload ID: 10804
  Gene Symbol: NAA11
  Gene Name: N(alpha)-acetyltransferase 11, NatA catalytic subunit
  ENST ID: ENST00000511542
  CDS Start-End: 1-336
ttgcacctttattctaacaccctcaactttcagattagtgaggtggaacctaaatactatgcagatggggaagatgcttatgctatgaagcgggatctctcgcagatggcagatgagctgagacgacaaatggacctgaagaagggcgggtatgtggtcctgggctccagggagaaccaggagacccagggcagcacactttctgattctgaagaggcctgtcagcaaaagaacccggctaccgaagaaagtggcagtgacagcaaagaacctaaggagtctgtggagagcaccaacgtccaggacagctcagaaagctcggattccacctcctagagcatgcttaagaatgccacagactgagtgatttacacttaatggaggccaggaagttcaatatcaaggtggtgacatctggcaagggccttcttgctgcatcatcccatgaaggtgagaagatgaaaagccaatgaagatctgagacagcacaacctaaggaatgggggaacaacaggatggagaacctgggtccatgaatgatctcatggagcagagctgcttacccatcttgaaatatgtggcattcacttagtgttcaagaatttagtggcaaaacacacactcacactcacacacacacactcttacacatgcagattttgaaatttggaaagctgataactctggtgatgctatggtaaaatattccataaaactgacatgagctaacttgggaaggatataacttttccacagaatctatagtatgggggcaaaccattgaaaagggcagaatgtgtgtgttgacagttgcttgatatttttataagatgctataagacagagatggattgacaattgaccagtttgccggcagctttttaacgggagatccccctatgcctgcagcctataatctgtattaactagaagcaattaacttattcccctgcagatttggaaaagccaactacttctactcaccaaagagcagaaagtaagactccagacttaaaggaaaagaagacttccctt

SEQ ID NO: 157156 - DNA, 6222 bp, Homo sapiens
  Payload ID: 10805
  Gene Symbol: NAA15
  Gene Name: N(alpha)-acetyltransferase 15, NatA auxiliary subunit
  Uniprot ID: Q9BXJ9
  ENST ID: ENST00000296543
  CDS Start-End: 324-2924
gtgttaggaagcgtgacccgggtgggaaaaccctccgcgtccgccattttggctgcctctgtcggtctgttcagttaccacgtgaaccgccgacggagacccgtagtgggggaggcggcggcagcgttaagtgagaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgcagtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagattttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttatattcagctactcttgtcatttctcgttgaaaaactaaaatctgactaggttagtttactcagctttaattagatagttgagtcatatattttcaacatttttctgtatcgtatttattatgcacaaaaataaagtgtgatctctaatagcatggctaaaggtaatgccaatattagtgaatagctttgctgtgggctttatcaggcccttgtttttcacagtgttgtttgtactccatggtgtattgctattagagctgtgaaatgaaagctgtgactttatgaagagatcaaaaaaagtgtggtccagattcaggtaggttgtggtaagttcagggaagtcttgtatgatttctaagaatatttcagttaccatgtatagtatttgggaaaagctgtaatgtaaaatattggactttgttgcaagataggtatatacttgtgtcagataattaaagccttaaattttgaaatgaatctttgagatttcaaagaaagactgacctttcaaatagaaggcggtctttctattctagctaatgccccacttctttaagttataaacaaagtttcatgataccattctgctatcatctaaactttgctgaactctactgccaacctacattaaaaacaaagtcccacgaaatggctgtgttacaccatagtgagcagaaacttaaattttgttctaattttgatggttgaaaaatttcaacctgtagcaataaaacatttttggaaaa

SEQ ID NO: 157157 - DNA, 6072 bp, Homo sapiens
  Payload ID: 10805
  Gene Symbol: NAA15
  Gene Name: N(alpha)-acetyltransferase 15, NatA auxiliary subunit
  ENST ID: ENST00000398947
  CDS Start-End: 191-2788
agaaaggaaaaaagacaacgaggaaaaaggaggtgtccgggtagggcaacgcggcgacacccgaggcctggtggtggcggcggatcgagatattcaaggctgaagcagctacggaacggcagcggcggcggtcggacaaactgactgaccgagccgggtggtggcgggagcagcgggagcagccggaacgatgccggccgtgagcctcccgcccaaggagaatgcgctcttcaagcggatcttgaggtgttatgaacataaacagtatagaaatggattgaaattctgtaaacaaatactttctaatcccaaatttgcagagcatggagaaaccttggctatgaaaggattaacattgaactgtttggggaaaaaggaagaagcttatgaattggttcgtagaggtttgagaaatgacttgaagagtcatgtgtgttggcacgtttatggccttcttcagaggtcagacaagaagtatgatgaagccattaagtgttacagaaatgcactaaaatgggataaagacaatcttcaaatcttaagggacctttccttactacagattcaaatgcgagatcttgagggttacagggaaacgaggtatcagttacttcagcttcgacctgcgcagagagcatcatggattggttatgctattgcttaccatttattagaagattatgaaatggcagcaaagattttagaagaatttaggaaaacacaacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggggaacttctgttgcaactatgtcgtttggaagatgctgcagatgtttatagaggattgcaagagagaaatcctgaaaactgggcctattacaaaggcttggaaaaagcactcaagccagctaatatgttagaacggctaaaaatttatgaggaagcctggactaaatatcccaggggactggtgccaagaaggctgccgttaaactttttatctggtgagaagtttaaagaatgtttggataagttcctaaggatgaatttcagcaagggttgcccaccagtcttcaatactttaagatcattatacaaagacaaagaaaaggtggcaatcatagaagagttagtagtaggttatgaaacctctctaaaaagctgccggttatttaaccccaatgatgatggaaaggaggaaccaccaaccacattactttgggtccagtactacttggcacaacattatgacaaaattggtcagccatctattgctttggagtacataaatactgctattgaaagtacacctacattaatagaactctttctcgtgaaagctaaaatctataagcatgctggaaatattaaagaagctgcaaggtggatggatgaggcccaggccttggacacagcagacagatttatcaactccaaatgtgcaaaatacatgctaaaagccaacctgattaaagaagctgaagaaatgtgctcaaagtttacaagggaaggaacatcagcggtagagaatttgaatgaaatgcagtgcatgtggttccaaacagaatgtgcccaggcttataaagcaatgaataaatttggtgaagcacttaagaaatgtcatgagattgagagacattttatagaaatcactgatgaccagtttgactttcatacatactgtatgaggaagattacccttagatcatatgtggacttattaaaactagaagatgtacttcgacagcatccattttacttcaaggcagcaagaattgctatagagatctatttgaagcttcatgacaacccccttacagatgagaataaagaacacgaagctgatacagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggttgaaactccattggaagaagctattaaatttttaacaccgttgaagaacttggtgaagaacaagatagagactcatctttttgcctttgagatttactttaggaaagaaaagtttcttttgatgctacaatcagtaaagagggcatttgctattgattctagtcatccctggcttcatgagtgtatgattcgtctctttaatactgtgtgtgaaagtaaagatttatctgatacagttagaacagtattaaaacaagaaatgaatcgtctttttggagcaacgaatccaaagaattttaatgaaacttttctgaaaaggaattctgattcattgccacacagattatcagctgccaaaatggtatattacttagatccttctagtcagaagcgagctatagagttggcaacaacacttgatgaatctctcactaacagaaacctccagacatgtatggaggtattggaagccttgtatgatggtagcctaggagactgtaaagaagctgctgaaatttatagagcaaattgtcataagcttttcccttatgctttggctttcatgcctcctggatatgaagaggatatgaagatcacagttaatggagatagttctgcagaagctgaagaactggccaatgaaatttgaacatcactaaacaagcaaatggaatgactttggaccatatctagtatataatatttttgtcacgcacctgctgcattgctctaacttacacagaatgagaggagtaaatgttcttgccttcaaatagtgttttacgttttttatcctgctgaaaaagtatatataaaatatctaacattacaggatagaggttcagtttcttaaaaaattaaagctgctaaaattgagtggttaaaaaagataccttatcctattcctccccacccacccatgtttttaaactaatttatataaaatctggaggctgttacagctaacaaagcaggtgtgtggcagaaatattactttaaatttgtcttgtgagattttactatatctcagacagcataaatgctgttttagcactggattctttcactgagcacaaagagttgttggggctttagcatctgactgattttgttacggggttgattctgaccataggaagtatgcaatgtgaatcactatttacagagaaacctacaacagatgcttgatgttgtagaaactgggacatatagataccaagcaaaattataagaaacctataaggtgttcaatacgcttgtgtttccaaaattcactgtacatgatcagtttggtgttcttgtaccacagtttttaactgaaggaaccagttgtaacagtctcaattttaactaaaacttgaagaactaaaacaacaatgcaaacctttcagcattgtttggccaaacttgttaaaactgtaatgcaagaaccaaatgcactgtgatgtggcaccaactaattagcaagcatgaatttttcacccaagagtgaaaaaaggaaaatctaccatggcttgaagttaaagagcagaactcctgactaccattctatgactgatcaaaagactaatagttaaaaacctcagcaggccttgttcacgatatgcagaaaaaaaagtgctgcagtttagatacctctggaatttttccacagtgtcacaggtttgtaatacttgaagccctacatttctaagaatatatttcttgctcagttgtttcaggcaagcccaagactttgtaatttttaaagggcccaagattttttttttttttttttttttcaaataacagaccagcttctttttcttgcagttacagatgtaatttcctttttgttgtcaaacataaggtaccaaatatgatgcaataaattgttttgaaaaacagttgtgtgaatatttcaactaatctgtgttgggcttctgtgaaatacacaggtggaaacagaggtgcaagccagaggcaatgtaatatgctgtaaggctagtgcagatgggagctttttagaaggggctaagtgctggtgtcagggaaattccataatgaagtagaatgctgctcctgcattaagatttcattgagggcaaggctggtggcaggtactatgaatgtaattcataatttaaaaggaaaactaaaaactattttgatttgggaaaatgagccttaatttgttaaacctatacactgagaactagcctcaggcttaatattctcattgcatttgcaagatctgagcaaataagattaagtaaaacaaatcaattgtatatataattgacctttttgtggaacatgtagtttatagaaagtatactctaaagggaatttgccgaagaccttttactgattgaacagttgtgctacaatcaacttttcatagtacatgacctgcattccacatctcagtctaacagtttagtagtgatgtaaagagaagtacaaaccgaactccagtgctttgttatgttttattaactggccctgtctcaggaacatcttaacagatggcaaaaaaacaaaaactttttttcaactcctatgagtggcaactgaagttcttattgttgggaaagaacactagtcctacctctgccactaatgaggtgtttggaggaggtaccagccatataatagggggtgtatgtgtgaattttgtttaaactctactgtatattgaaatgaaattcatttatttgtcttgacaatgttcaaatgatgtagattgtcttagaatgaatattcataagtactcagaactcttaagatgcagatgccacccgtgaggagctaaattcctaatgtgtattgtattccaacccaattttactggaactattgaataaatcttttattttctttcaggtttacttgatagtggatacattggtgtcagaggaccttgactgggttcattttatgtccagacatcacccctgaaacactgtactgtactatcttgctctgagtagtatcaactggatcgtctcatatttgcctcattcatcctattaatttcaaatgatactgtgggggaaaaacagggttagaaaaacaagtggaaaaaatggagtgatgttgtaatctaaacaagtgccttatgtttattgctaagaactggtgttaccaacccttttgagaagaaagggtctcttgacctgtattaacataggaaagtaaagttctttttgtttttctttatattcagctactcttgtcatttctcgttgaaaaactaaaatctgactaggttagtttactcagctttaattagatagttgagtcatatattttcaacatttttctgtatcgtatttattatgcacaaaaataaagtgtgatctctaatagcatggctaaaggtaatgccaatattagtgaatagctttgctgtgggctttatcaggcccttgtttttcacagtgttgtttgtactccatggtgtattgctattagagctgtgaaatgaaagctgtgactttatgaagagatcaaaaaaagtgtggtccagattcaggtaggttgtggtaagttcagggaagtcttgtatgatttctaagaatatttcagttaccatgtatagtatttgggaaaagctgtaatgtaaaatattggactttgttgcaagataggtatatacttgtgtcagataattaaagccttaaattttgaaatgaatctttgagatttcaaagaaagactgacctttcaaatagaaggcggtctttctattctagctaatgccccacttctttaagttataaacaaagtttcatgataccattctgctatcatctaaactttgctgaactctactgccaacctacattaaaaacaaagtcccacgaaatggctgtgttacaccatagtgagcagaaacttaaattttgttctaattttgatggttgaaaaatttcaacctgtagcaataaa

SEQ ID NO: 157158 - DNA, 2456 bp, Homo sapiens
  Payload ID: 10805
  Gene Symbol: NAA15
  Gene Name: N(alpha)-acetyltransferase 15, NatA auxiliary subunit
  ENST ID: ENST00000515576
  CDS Start-End: 76-372
cagaagcgagctatagagttggcaacaacacttgatgaatctctcactaacagaaacctccagtttgtcagaggaatggctgtgaatggatgcctggaaggaccatcctctaattttctcagttgcctgttcattgtggcattggttggcagtgaatctactcatcctttatgtcttgagcaaccagccacccagagatgtggtcttgctatgttgcccaagctgatcttcaactcctggcctcaagggatcctcccgcttcagcctcccaaagcattgggcttacagtcacagcaggatttccaagctcctggagattgcctgtccagtggcagcaacaccaaagacttagactgtaaagaaagcctctaaaattcccagtgttcctggatttaaataacacatccagagttcttcccagtcacaactccagctggattttagaggcacaaagagctgaatgtgatcctggtaaatctacccccgacccatcacaatatccacctgctttataaactgcctaacagaacaattccaagagattataataacacgctacaaactgcttaaaagaacaatcccaagaggctataatgagacctttttttaaaaaaatagaaataaccccatcatacctcatttccctatttgcatcttttaaagtccattgtatagaattgtaacaccatcatgctttgctctaatatagcctaatttcccattcctttttttttttttttttttgagacggagtcttgctctgtcacccatgctggagtgcagtggtgcgatcttgtctcactgcaaactctgcctcccggattcaagcaattctcctgcctcagcctcccaagtagctgggattacaggcatgagccaccacacccagctaatttttgtgttttagtagagacagggtttcaccatgttggccaggctggtctcgaactcctcacctcaggtgatctgcctggctcgacctcccaaggtgctgggattacaggcatgagcccctgtgcccaggctcccactcctcttaatctgtgttgacccttccactgtattgtcatcagtcaaatcccctaatccttaacaccttttctaaacattcctttcattttcttactctaaccaaaacctaaccatctcctaataatattgctttccttgcaatactctcaaattgtgtctgcttttaaaaattactcaacccacttaccaaaggagcctagagatgaggtaggtgtcctgcttattccccactgccaattccagaccttttttctcctttgaaaattctagttcccttgaccatatcatccattctcctttttttttttacagtcgtctactgtcttcctggtctctcaccctcattgcagaagagcttagcatgcagtgtcttgttttcctttccactgctactgctgtcattattcttttttttttagatggagtctcgctccgttgcccaggctggagtgagtgcagtgtcgcgatcttggctcactgcaagctccgcctcctgggttcaagcaattctcctgcctcagcctcccgagtagctaagactacaggtgcctgccaccacgccaggctaattttttgtatttttagtggagacagagtttcaccattttagccagggtggtctagatctcctgacctcgtgatccgcctgcctcggcctcctgaagtgctgggattacaggcatgagccaccgtgaccggccagctgtcattatttttaacattaacaattcatctattaccttagctatggatggtgctatgtaatttgccctgcctgctccttcaccttcacatcctgccactctcccctgttaagtcagaaactgtgaagtgtcttagagtttgtccttcttgcaagctaataggttagcttgccacagtttcatatacatatactgccagaagacaccagactgctgggctggtgccataaaagatttgctactgaaagcacaaagcatttacaacaccttgtgtcatttccccatgccccatttcccgtaaggcaacagatgtttcctgtgcagtgggttgcatcacaggagaagaatcttaaatttagaagcctccaagcttttatcaaagctgctggtgacctacccattcctcccattcaggagagaaattattcattatcttgaaatgtaagtgaatttcctctgggaagaggaagaaggcccctctaggtttatcaccctggaatgtaacacactctggggtttgggaggtggatattaatatcattatgcgctttctcacctacagaagactagtctgaacttgtggcaggaacctagccagcttgattgcctgctaaaacaaaaatatcaacattcttaataggatttaaataagatccagcatctcaaaacagaatattcaaaatatccatgatacggtccaaaattacaaagcaaacaaac

SEQ ID NO: 157159 - DNA, 4347 bp, Homo sapiens
  Payload ID: 10806
  Gene Symbol: NAA16
  Gene Name: N(alpha)-acetyltransferase 16, NatA auxiliary subunit
  Uniprot ID: Q6N069
  ENST ID: ENST00000379406
  CDS Start-End: 325-2919
aaagggcgctccgcgcatgcgcacaggatccggctcgggaggcggaccctggctgccatcttgcagtgcgcgggaaccgccgccgccgccgctggccaaaaagcggagcccaggggaagcgtgtcctgctcagaccgccttccttctccattgccacccgtgccgaacagccaggctgcccaattgcaactgtagaccaatgaactaatccatcgcccgcagcccgactctcagcagcggttcgtcccggtgcccacccccgcgaagcggagcgcccgggcacctagcctccctgccggccacctagcctccctgccggccacgatgccgaacgtgctgctgccgcccaaggagagcaacctcttcaaacgcatcttgaaatgttatgaacagaagcagtacaaaaatggcctcaagttttgcaagatgattctgtcgaacccaaaatttgctgaacatggagagactttggctatgaaaggattaacactgaactgtttaggaaaaaaagaagaagcttatgagtttgttcgtaaaggacttcgtaatgatgtcaagagtcatgtctgttggcatgtatatggactcttgcagcgttctgataaaaaatatgatgaagctataaaatgttaccgaaatgccctcaaattagataaagataacctgcaaattttgagggatctctcactgttgcagatccaaatgagagaccttgaaggttaccgagagacaagataccagcttcttcagttgcgccccacacagcgtgcctcctggattggatatgctattgcataccatttgctgaaagattatgatatggccctaaaactgttggaagaatttagacaaactcagcaagttcctccaaacaaaatagattatgaatatagtgaattgatattataccagaatcaagtgatgagagaggcagatctgttgcaggaatctttggaacatatagaaatgtatgagaaacaaatatgtgataaacttttggtggaagaaattaaaggggaaatactgttgaaattgggaagattaaaagaagccagtgaagtgttcaaaaacttgattgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtgaaagatttagagaactaatggataagttcctgagggttaacttcagtaaaggctgcccacccttgtttactactttgaaatctttatattacaatacagaaaaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaagcatataggtaatctcaaagaagctgcaaagtggatggatgaagcacagtctttggacacagctgatagattcatcaattccaaatgtgcaaaatacatgcttcgagcaaatatgataaaagaagcagaggaaatgtgctccaagttcacaagggaaggaacatctgccatggaaaatctaaatgaaatgcagtgtatgtggtttcagacagaatgcatttcagcttatcagcgtctggggagatacggggatgccttgaaaaaatgtcatgaagtagaaaggcatttttttgagataactgatgaccaattcgacttccatacatactgcatgagaaagatgacccttcgtgcctatgttgaccttttgagattagaagatatactcagaagacatgccttttatttcaaggctgctagatcagcgattgaaatatacttgaaattgtatgataatcccttaaccaatgaaagcaaacaacaagaaataaactcagaaaacttgtcagccaaagaattgaagaaaatgcttagcaagcagagaagagctcagaaaaaggctaaactagaagaagaaagaaagcatgcagaaagagaacgtcaacagaaaaatcaaaagaaaaaaagagatgaagaagaagaagaagccagtggccttaaggaagaacttatacctgaaaaattagaaagggtagaaaatccattagaggaagccgttaagttccttatacctcttaagaaccttgttgctgataacattgacactcatctgttagcatttgaaatatattttagaaaaggaaagtttctgttaatgctgcagtctgtcaaacgagcttttgccattaacagtaataacccatggttacatgaatgtttaattagattttctaaatctgtgtctaatcatagtaatcttccagacattgtgagcaaagttctatctcaagaaatgcagaaaatatttgtcaaaaaggatttggaaagttttaatgaggattttctgaaacgtaacgctacctctcttcagcatctactttcaggtgctaaaatgatgtattttctggacaagtcaaggcaggagaaagcaattgctatagccactagactagatgaaactataaaagataaagatgtaaagacattaataaaggtttctgaagcactgcttgatggcagctttgggaactgtagttcccaatatgaagaatataggatggcctgtcataacctgcttccttttacatctgccttcttgcctgctgtgaatgaagtcgacaatcctaatgtggcactgaaccatacagctaattatgatgtcttggcaaatgaaatttgaaatcttctagaaagtagactcctatagactcaaagctgaattgagatcagggtttcttttccagggtgcattttaatatacgtatgaaatgaaatatttggttaggatttttaaatggcatattctgtaagcttattttgttctttacccgacctgccaatttacataaccatctgttaaaattacctgtttattcttacacagttttgtggtagctccgatcgcttctgtataattataatttcttactaagctaagttgtatacaaccccactgtattattttctttagattctgatttcaggatctgtgctttgattccttgtctgttttatcgtatatttgcttgctttttaattaaagcacatcagttttaaagtgttaactatatgttaacaatatggaggctgggcgtggtggctcacacctgtaatcccagcactttgggaggcccagactggcggatcacctgaggtcaggagatcgagatcagcctggccaacatggtgaaaccccttctctactgaaaatacaaaaattagccagacgtgatggcacatacctgtaatccaagctgcccaggagctgaggccggagaatcgcttgaacctgggaggtggaggttgcagtgagccgagatcatgccactgcactccagcctgggcaacagagcaagactccatctcgaaaaaaaggaattcctcttggcagatattgaagtttatttgaaaatttaattcgtccttttttcattgtaatatttcatggtttactatttccttttagtattcatgaaaatggtattttctggttgaataagggtactctagttttatgtagatgatttcagaatgtgaaggctggtttgcctgtcagtcatggaaattcactggtaaaattgttgaatatttctctctcccagtcttaaaagcccacaggcaagaattaatgctttcttaactaagttactttgagtattaacaagtagcttatactgaggtgtgcttcaagggagcattatagggcagaaaacaaattaaaatgaaatgttgttgttatagccatgcattgaccattaaatgcattttaatatctcggcaaaatgagatttgaaactcattagtttaactcttaaaacatagtgttgttaaacagtattttttgggggcgggtggatagctttttgttctatcttgtacagaaaacagtaatggaatcactcatgttcagaaccttgtaaatatgtctgtaatattaatgcttccctttattaagacaaatatacattcaaaaagggagattttatttagacacacattttcttttcaccctaatctatttagattcatacttattgagacgggaaaaactcgctgtaaaataatgccaacctagataatgctataataaattattttgtacacagtt

SEQ ID NO: 157160 - DNA, 1751 bp, Homo sapiens
  Payload ID: 10806
  Gene Symbol: NAA16
  Gene Name: N(alpha)-acetyltransferase 16, NatA auxiliary subunit
  Uniprot ID: Q6N069
  ENST ID: ENST00000403412
  CDS Start-End: 250-1539
accgccgccgccgccgctggccaaaaagcggagcccaggggaagcgtgtcctgctcagaccgccttccttctccattgccacccgtgccgaacagccaggctgcccaattgcaactgtagaccaatgaactaatccatcgcccgcagcccgactctcagcagcggttcgtcccggtgcccacccccgcgaagcggagcgcccgggcacctagcctccctgccggccacctagcctccctgccggccacgatgccgaacgtgctgctgccgcccaaggagagcaacctcttcaaacgcatcttgaaatgttatgaacagaagcagtacaaaaatggcctcaagttttgcaagatgattctgtcgaacccaaaatttgctgaacatggagagactttggctatgaaaggattaacactgaactgtttaggaaaaaaagaagaagcttatgagtttgttcgtaaaggacttcgtaatgatgtcaagagtcatgtctgttggcatgtatatggactcttgcagcgttctgataaaaaatatgatgaagctataaaatgttaccgaaatgccctcaaattagataaagataacctgcaaattttgagggatctctcactgttgcagatccaaatgagagaccttgaaggttaccgagagacaagataccagcttcttcagttgcgccccacacagcgtgcctcctggattggatatgctattgcataccatttgctgaaagattatgatatggccctaaaactgttggaagaatttagacaaactcagcaagttcctccaaacaaaatagattatgaatatagtgaattgatattataccagaatcaagtgatgagagaggcagatctgttgcaggaatctttggaacatatagaaatgtatgagaaacaaatatgtgataaacttttggtggaagaaattaaaggggaaatactgttgaaattgggaagattaaaagaagccagtgaagtgttcaaaaacttgattgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtgaaagatttagagaactaatggataagttcctgagggttaacttcagtaaaggctgcccacccttgtttactactttgaaatctttatattacaatacagaaaaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaaggtaaaatctgaatcctgttttttgagtagttgaagaattcagctactttaagaatccttggagttttttctttgtggaaacaagttctagggcaccctgataatctttttctaataatcctgtgtagtttcatgttatattaattgtataatcaatgtgtaattagatgtgtaatcatttgagctcttagtaaatgtgaactgtaattttgatttctaaataaatttgacagaaatggtgacaga

SEQ ID NO: 157161 - DNA, 2816 bp, Homo sapiens
  Payload ID: 10806
  Gene Symbol: NAA16
  Gene Name: N(alpha)-acetyltransferase 16, NatA auxiliary subunit
  Uniprot ID: Q6N069
  ENST ID: ENST00000464857
  CDS Start-End: 235-1785
gctggccaaaaagcggagcccaggggaagcgtgtcctgctcagaccgccttccttctccattgccacccgtgccgaacagccaggctgcccaattgcaactgtagaccaatgaactaatccatcgcccgcagcccgactctcagcagcggttcgtcccggtgcccacccccgcgaagcggagcgcccgggcacctagcctccctgccggccacctagcctccctgccggccacgatgccgaacgtgctgctgccgcccaaggagagcaacctcttcaaacgcatcttgaaatgttatgaacagaagcagtacaaaaatggcctcaagttttgcaagatgattctgtcgaacccaaaatttgctgaacatggagagactttggctatgaaaggattaacactgaactgtttaggaaaaaaagaagaagcttatgagtttgttcgtaaaggacttcgtaatgatgtcaagagtcatgtctgttggcatgtatatggactcttgcagcgttctgataaaaaatatgatgaagctataaaatgttaccgaaatgccctcaaattagataaagataacctgcaaattttgagggatctctcactgttgcagatccaaatgagagaccttgaaggttaccgagagacaagataccagcttcttcagttgcgccccacacagcgtgcctcctggattggatatgctattgcataccatttgctgaaagattatgatatggccctaaaactgttggaagaatttagacaaactcagcaagttcctccaaacaaaatagattatgaatatagtgaattgatattataccagaatcaagtgatgagagaggcagatctgttgcaggaatctttggaacatatagaaatgtatgagaaacaaatatgtgataaacttttggtggaagaaattaaaggggaaatactgttgaaattgggaagattaaaagaagccagtgaagtgttcaaaaacttgattgatcgaaatgcagaaaattggtgttattatgaaggcttggaaaaagctctacaaattagcactttagaagagaggcttcaaatttatgaagaaattagtaagcagcaccccaaagcaattacacccagaagattacctttgactcttgtcccaggtgaaagatttagagaactaatggataagttcctgagggttaacttcagtaaaggctgcccacccttgtttactactttgaaatctttatattacaatacagaaaaggtttctataatccaggaacttgttactaattatgaagcctctcttaaaacgtgtgacttttttagcccatatgagaatggggagaaggaacccccgacaacactactctgggttcagtatttcctggcacagcactttgataaacttggacagtattctttggctttggattatattaatgctgcaattgctagtactccaactctaatagaattattctatatgaaagcaaaaatttacaagcatataggtaatctcaaagaagctgcaaagtggatggatgaagcacagtctttggacacagctgatagattcatcaattccaaatgtgcaaaatacatgcttcgagcaaatatgataaaagaagcagaggaaatgtgctccaagttcacaagggaaggaacatctgccatggaaaatctaaatgaaatgcagtgtatgtggtttcagacagaatgcatttcagcttatcagcgtctggggagatacggggatgccttgaaaaaatgtcatgaagtagaaagggtaagttgttagaatttcgacttcagttttcactgtaaggtgataaaaagcaggtagatttctacacaggatcatctgcctcttctaacttctctgggagcttcattgtgaaaaaaattcttgatctttaacctttacattcagaagttgtaaacaatggattgctttactgatcctcaagtgattatgcttttgacatgtctatatatttttgtctgaaggaaaaagattgttagtaaacaattattgctattaacataaattcaaaatttatgttccctaattaggccattattttgatattcatcaccaccctaagaggacacacagctgatggcaacctctttcccctttaaaacatcaggatctggtccgcagtcagcctctctccagtttgtcttcccaggatatttgctctcacattcagtattctgtataacaatctatggccagtttgcaggcttattttattgcttgcttttaggattatttgtgtgatgtgccttagtgaggggacttttcttttcctttgtgtgaatttttgttttcctgttctttgtcatctctgaagcactctccttccacatggaccacaggaggaaaagagccgcaaatgcacccctgaggcagtcctcagcagccctcagttgtgggggcaatcggcaccactgttcccatcctgacgcagtatagaaccacaggcatcgtagtcagcatttttttgagataactgatgaccaattcgacttccatacatactgcatgagaaagatgacccttcgtgcctatgttgaccttttgagattagaagatatactcagaagacatgccttttatttcaaggctgctagatcagcgattgaaatatacttgaaattgtatgataatcccttaaccaatgaaagcaaacaacaagaaataaactcagaaaacttgtcagccaaagaattgaagaaaatgcttagcaagcagagaagagctcagaaaaaggctaaactagaagaagaaagaaagcatgcagaaagagaacgtcaacagaaaaa

SEQ ID NO: 157162 - DNA, 920 bp, Homo sapiens
  Payload ID: 10807
  Gene Symbol: NAA20
  Gene Name: N(alpha)-acetyltransferase 20, NatB catalytic subunit
  Uniprot ID: P61599
  ENST ID: ENST00000310450
  CDS Start-End: 88-423
ggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaa

SEQ ID NO: 157163 - DNA, 1260 bp, Homo sapiens
  Payload ID: 10807
  Gene Symbol: NAA20
  Gene Name: N(alpha)-acetyltransferase 20, NatB catalytic subunit
  Uniprot ID: P61599
  ENST ID: ENST00000334982
  CDS Start-End: 282-818
tttccttcccaggtgtcgccgcctgctttctgcagccgctgcctgggaggggttccgaggttctgggcagccacagccccggaggccttacaggagcgacctggcaattcccgccgccggccgccagaggaagctgctttgctgctgtcgttgcccagcaactcgtagcccggaagcagtaccccgtctcgctcggttccgcggcggccacgctccgggagacttccggcagggcgggcgcggggtcttggcgaacggtcttcggaagcggcggcggcgcgatgaccacgctacgggcctttacctgcgacgacctgttccgcttcaacaacattaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaa

SEQ ID NO: 157164 - DNA, 1604 bp, Homo sapiens
  Payload ID: 10807
  Gene Symbol: NAA20
  Gene Name: N(alpha)-acetyltransferase 20, NatB catalytic subunit
  ENST ID: ENST00000398602
  CDS Start-End: 636-1136
cggcgcgatgaccacgctacgggcctttacctgcgacgacctgttccgcttcaacaacatgtgagtgacacgcgcctagggccagccgctcttggccgggcctcgcttcccggccccgccagctccggccccagccgcgccttcccggccggaccccaagcccggacggggacccgcgagaaccaccccccgccggccaacgtgggcgcctccctggggccacagggtccagggagaggtgggcctggagtcgacgcacgccggccttggcgaccttggccgaggtgctcaaactttgtctctggaccctgcgagctggcaggttctggggcagcgctcgggcctccgctcgtggtcgctgtcaggaggcgctggggtgatggggcgagctggagacgcggcctggagcccacgacctgggcttctcgccctgccctactgcttgctggttcgtggccgggccgcgcctcttctgggcagagggcaccgccgacggccaggccgcagagggggcttgcgaggatcggaagctggtcagcagctgttgggatgtgtacatcgtgaagcccacctggtggccgtggttaaattgtatccaaatgaaatgacactgatcactgcgtcccctgcagcagatgctgtctcagtcatgtaacttggatccacttacagaaacttatgggattcctttctacctacaatacctcgcccactggccagagtatttcattgttgcagaggcacctggtggagaattaatgggttatattatgggtaaagcagaaggctcagtagctagggaagaatggcacgggcacgtcacagctctgtctgttgccccagaatttcgacgccttggtttggctgctaaacttatggagttactagaggagatttcagaaagaaagggtggattttttgtggatctctttgtaagagtatctaaccaagttgcagttaacatgtacaagcagttgggctacagtgtatataggacggtcatagagtactattcggccagcaacggggagcctgatgaggacgcttatgatatgaggaaagcactttccagggatactgagaagaaatccatcataccattacctcatcctgtgaggcctgaagacattgaataaccctgggcagtggttcttaggcagatactctagatgctttatggacaatattattttcattggatgattctggagctctattaggagaaaagtaatcattttaggtcttaaagacttcaagaaaatacaggttatcaatttattttaaatctcattgtttccagttagcaatatcatacctattaaagctgttcattgtaacaaaattcaatcaaaaaggcagctaggtcagaaggaaacataccactctcatggttcatagtattcactgtatgtatgctagggaaaagacttgctccagtctcctcctcagttctgtgcctgagaaccactgctgcatatatttgtttttaaattttgtattgaactgttaattgaagctttaaaagcatatatgaaatgtataaatctaagatgtataatacattattgactctatgaatgttttctgaagtttgttagtcattt

SEQ ID NO: 157165 - DNA, 6010 bp, Homo sapiens
  Payload ID: 10808
  Gene Symbol: NAA25
  Gene Name: N(alpha)-acetyltransferase 25, NatB auxiliary subunit
  Uniprot ID: Q14CX7
  ENST ID: ENST00000261745
  CDS Start-End: 250-3168
agtgactcggaagactttaacagcaacagctgcctcctcttgccagcttgatcccacctgctaagtgaaggaacagcgtttaaagaggtggcaatcggcaagggtggatgcttccctttccgcgcaggcgcgttcagtcgcagcaccgcgactatcgtgatagacaagcgagatcgacgctggccctttaatagccctttcccggggtcctgccccgcgcgtgcgcactgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaatattatggatttagccttaggctttaagttttaggctggcaaaagaaatgttattcagtgggtttgaggtttggactactttcttcaaacttagagaattataacaggatggtgtttactttgttcacctggatgtccccaagactctagcttcttctatcagtggttggtctgatagaagaggtaaaaattgctcttgaaaatgtcctacaatttatgcagtttctttgataatatttttctgtttaaatccctgcttctgtttttggtctgttacctaaatatagttcaagtttaattctgtaagagcaaagaaatgaatttgatgaggaaattaagcatccaatggaggattggtcttgaagaccttaaaggtgctttccaacctgcactgctccagtgaaatgtggtacttttttcttttaaaagcaaccaagagagctgggaatatctgtgtacgcaaagtaattgcattttgtcccttcattttgactttcttagattcataatttgatacagtgcttaaacttccaaggaaattttaaacaattactacattacctgttcaaaataaggcttgttggaaatcctagtccatcaactaatttcaaaaatttatttttgatatgagtagcaacagctggtcatataccctatcccaaaaggaagaactgtcttgaacaagatgaatggaaaattgtggttaattctgaatttcatgtaatgacaacatattctttcataaaactatggcctgtttaagatggaactttgtgtgtgtctgctggggagggtggggtacatgtgtatggcgtgtgttcttgaaatgatgtctctctgaatatccaaaaaagtactgtactgtagaaatgctctttgaaaaagtctatcgactgaccatgatcaatctagcatatgtatgttcagtgggctagccttggtcctcagggacagtgtgtgactctagtggtcttcctaaccagtctcttgcctaaagatatctgggacctctactggctttaatgacaaataatgttatgttgaggttatgcttcctttgttatttgctgattttcctactaaatgtagcatttcaattagatccagctttcacattttgagataattgtaaaaagaatgaaattatgcagaaatggccaatatctcttatcaatctgttcttttggaaaccctcatgtactataaattgtgtacagttaaaaaaatatatatatatatatattcttacatgagtaaaaagcaccctctcccagcaatcgtatgccattggtatttgaagagaattcccaaataacccattgctgctgctgctgtttttgatttgtatgggtttttttgttttgtttgtttttgtgtggtaaactgatatttaaaaaaggaaaggagaaaaatcacgactactgtttacagactgaaaaattattgctttttatactactgagatcctaagttaagactctccaaagcaaacatttggtttaaatcatttatctgatgtagataaaaggtagagaaacttgtagtgttctccacataatggaaaatgtacaaatgcctagttgtgttgcccatcaattttgtatattttcataattttaattgttgaaaattgcattatattttgcaatcactatgttcaatctggatttgtctttcattttaacttttaatataaaaaggggtttcaatgtatctacaggcttgttattgaaacttcctacttatttgatgtgatttattaatataggaagtatatattcttccttaagtaagtgaagcatagcaaatctactttaaactggatgggttaatttatataaacattttcattttaagttggca

SEQ ID NO: 157166 - DNA, 2815 bp, Homo sapiens
  Payload ID: 10808
  Gene Symbol: NAA25
  Gene Name: N(alpha)-acetyltransferase 25, NatB auxiliary subunit
  ENST ID: ENST00000551858
  CDS Start-End: 7-120
gtcatcatggcgacgcggggccatgtgcaggaccctaacgacaggcgcctccggcccatttacgtagagatgggctttcaccgtgttagccaggatggtctcgatctcctgacctcatgatccacccgcctcagcttcccaaagtgctgggattacagccgtgagccaccacgcctggccgagacaactctttttctttgctgcacatcaatcaacttgcatccccgaaagtgccttcaaaatagaaattctggagctgccactgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttac

SEQ ID NO: 157167 - DNA, 421 bp, Homo sapiens
  Payload ID: 10808
  Gene Symbol: NAA25
  Gene Name: N(alpha)-acetyltransferase 25, NatB auxiliary subunit
  ENST ID: ENST00000547133
  CDS Start-End: 1-421
aacgacaggcgcctccggcccatttacggttttaaaggcaattggtttacagagaactggaaagcaagaggaagcctttactcttgcacaggaggtggcagcccttgaacccacagatgacaactcactgcaggcactgactatcctttaccgggagatgcaccgaccggagttagttacaaaactttatgaggcagctgtgaagaaagttcccaatagtgaggagtatcactctcacctcttcatggcctatgccagagtgggtgaatacaagaaaatgcaacaggctggcatggctctatataagattgtccccaaaaatccctactacttttggtctgtgatgagcttaattatgcaatctatatcggcacaggatgaaaacctctcaaaaacaatgtttctgccccttgctgagaga

SEQ ID NO: 157168 - DNA, 2933 bp, Homo sapiens
  Payload ID: 10808
  Gene Symbol: NAA25
  Gene Name: N(alpha)-acetyltransferase 25, NatB auxiliary subunit
  ENST ID: ENST00000549711
  CDS Start-End: 24-326
actgtggttctgcgcttgtcatcatggcgacgcggggccatgtgcaggaccctaacgacaggcgcctccggcccatttacgattatcttgacaatggtaataataaaatggcaattcagcaagcagataaactgttgaagaaacataaggatcttcattgtgctaaggttttaaaggcaattggtttacagagaactggaaagcaagaggaagcctttactcttgcacaggaggtggcagcccttgaacccacagatgacaactcactgcaggcactgactatcctttaccgggagatgcaccgacgctggcatggctctatataagattgtccccaaaaatccctactacttttggtctgtgatgagcttaattatgcaatctatatcggcacaggatgaaaacctctcaaaaacaatgtttctgccccttgctgagagaatggtcgaaaaaatggtgaaagaggacaagatagaagctgaggctgaagttgaactttattatatgatcctggaacgtttgggaaagtaccaggaggccttggatgtcatcagagggaaattaggagagaagttgacaagtgagattcagagtcgggaaaataaatgcatggctatgtacaagaagctgagcaggtggccagagtgcaatgccctttcccggcgcctcttactaaaaaactcagatgactggcagttctatctgacttatttcgattctgtctttcgactgattgaagaggcctggagtcctcctgctgaaggtgaacactctttagaaggagaagtacattattctgcagaaaaagctgtgaagtttatagaagatcggataacggaagaatctaaaagttctcgccatctccgaggaccacatctagctaaattggagctgattaggcgtttacgaagtcaaggttgtaacgatgagtacaaactgggtgatccagaagaattaatgttccagtattttaaaaagtttggcgataaaccttgttgttttacagaccttaaggtgtttgttgacctcttacctgctacacagtgtacaaaatttattaatcagttacttggagttgttcctttgtcgacaccaacagaggataagctggcactgcctgctgacatcagagctctgcagcaacatttgtgtgtggtgcagctgacgaggttacttggcttgtaccacaccatggataaaaatcagaaattgagtgtggtcagagaattgatgttaaggtaccagcatggactggaatttgggaaaacctgtttgaaaacagaattgcaattttctgactattactgtctccttgctgtccatgcgcttattgatgtatggagggaaacaggtgatgagaccactgtgtggcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactcaggttttttcactccaaccagaaagatatactgcaggcaaacagctcgccgaggtgtcccatgggggtttaaaagccgcatcgaatgcagttgaattagcgcccgtggcgcaatcccgcggcctgaaatgaaccctgcaaggctgtatatcagaggacctcagaatatattattcaagcttacaaatatggtgcatttgagaagatcccagagtttatcgcttttaggaacaggctgaataattctcttcattttgcacaagtccgtactgaacggatgctgttagaccttctacttgaagcaaatatatcaaccagtttagcagaaagtataaagtcaatgaaccttaggccagaagaagatgacattccatgggaagatttgcgagacaacagagacttaaatgtttttttcagctgggatccaaaagacagggacgtttctgaagaacataagaaactttccttagaggaggagaccttgtggttaagaatccgatccttaacattgaggctgataagtggacttccaagtctcaaccaccctgtggagccaaagaactcggagaagactgccgagaatggggtatcctcccggattgatattcttcgtttgctccttcaacagctggaggcaaccctggagacaggaaagcgatttattgagaaggatattcagtatcctttccttggtcctgtacctaccagaatgggtggattctttaattctggctgttctcagtgccagataagctctttttatcttgtcaatgatatttatgagctggataccagtggtttagaggatacaatggagattcaggaacgaatagaaaatagttttaagtctttactagaccagttaaaagatgtcttcagtaaatgtaaaggtgacctcttagaagttaaagatggtaacttgaaaacacatcctactcttttagaaaatctagttttctttgttgagactatttctgttatcctttgggtatccagttactgtgagagtgtcctacgaccatacaaactaaatttacagaaaaagaaaaagaagaaaaaagaaaccagcatcatcatgccacctgtctttaccagtttccaagactatgttactgggcttcagactttaatttccaatgttgtggatcatattaaagggcttgaaacacatctaattgcacttaaacttgaagaacttattttagaagacacttctctctcaccggaagagagaaaattttcaaagactgtgcaagggaaggtgcagagcagttatctgcactcacttctggaaatgggggagctgctgaaaaaaagacttgagaccac

SEQ ID NO: 157169 - DNA, 3754 bp, Homo sapiens
  Payload ID: 10809
  Gene Symbol: NAA30
  Gene Name: N(alpha)-acetyltransferase 30, NatC catalytic subunit
  ENST ID: ENST00000298406
  CDS Start-End: 1-524
cagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgctttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttg

SEQ ID NO: 157170 - DNA, 1294 bp, Homo sapiens
  Payload ID: 10809
  Gene Symbol: NAA30
  Gene Name: N(alpha)-acetyltransferase 30, NatC catalytic subunit
  ENST ID: ENST00000555166
  CDS Start-End: 166-480
aggcccaggaaactttacccggcctaacagctgaggcgctttacggcgacggcggctgagtgagaaccttggcggctgtggaggctgccgcggctgcgaaggaggcggcggcggtggcggaggaagaggagtggcggcagcggcggcggggacccgtgcggggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatgg

SEQ ID NO: 157171 - DNA, 795 bp, Homo sapiens
  Payload ID: 10809
  Gene Symbol: NAA30
  Gene Name: N(alpha)-acetyltransferase 30, NatC catalytic subunit
  ENST ID: ENST00000554703
  CDS Start-End: 122-271
ggcgacggcggctgagtgagaaccttggcggctgtggaggctgccgcggctgcgaaggaggcggcggcggtggcggaggaagaggagtggcggcagcggcggcggggacccgtgcggggccatggtaggggaggagtgtgtaggtgccatcgtttgcaagttggatatgcacaaaaagatgttccgcagaggttatatagccatgttagccgtggattccaaatacaggagaaatggcattggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctg

SEQ ID NO: 157172 - DNA, 7644 bp, Homo sapiens
  Payload ID: 10809
  Gene Symbol: NAA30
  Gene Name: N(alpha)-acetyltransferase 30, NatC catalytic subunit
  Uniprot ID: Q147X3
  ENST ID: ENST00000556492
  CDS Start-End: 155-1243
aaactttacccggcctaacagctgaggcgctttacggcgacggcggctgagtgagaaccttggcggctgtggaggctgccgcggctgcgaaggaggcggcggcggtggcggaggaagaggagtggcggcagcggcggcggggacccgtgcggggatggcggaggtaccgcctgggcctagcagcctcctcccaccaccagcacctccggccccggcggcggtcgagccccgctgtcccttcccggcgggggccgccctcgcctgctgcagcgaggacgaggaggacgacgaagagcacgaaggcggcggcagcaggagcccggcgggcggagagtcggcgacggtggcggccaaggggcatccgtgcctccgctgccctcagccgccgcaggagcagcagcagctcaacggattgattagccccgaactgcggcacctccgggcggccgcctccctcaagagcaaggtcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccgcacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtttactttagaagtccctttttccttacagtaacaagttgaatctacttggaaaattgagaaatggctcaaaagagataagaaaagttgatggagccgggaattgctggggtttagatgcactttttcttttgagagtaagggaagttttggaaaagaatagaaaattagtgtaagttgatatgattttatttaatcaaaattactgctacgctgcgaagaacagcttttacaaagtagctgaatttgtttttcccacttgatttggattcacattgctttcatttcttaaaatgcttcacttcaggttcttggtcttggaaataaatttcaaggtgcattgtatccattttaagctgctttattttattttcacttgtatgagcaaattcttgggggagctttgcttttcttctgccagaaaaacaaaagggggaaatgaaaatcttttttggaatgagttctgtgggttttcttaacagccaccatgtttattagttacattgtgttttggccaatcagtgcaatgtaacaaattttacagttaattgctttcaattgagtcagtaaacctgtgatagataatttatttaactggaaaacctaggtacccataagaaaaaagattcattctctgtgaaaactgtaggaatctgttgttgttttcatttgaatatgctctacttctgctctagtatttggtttggaatatattttgtggctctaattactgtatttttaaaaaccctacctccattaacagttggtaaaggccccttttcaggaaagtttgttgctttttttttttttttaaaggaaagctgctctttgctcagtatagtgttttgaaagtgaacatagtaacaaatactttaaaaataaagatacacaatttatatttgaaaataaaaactttctgctggtgggattatttatagttctttatttttaaagaaaatgttttcctttttatattgctcttgaaagtttaatgagcagaatacaatactggttataataaaaatatggtaaccacacagtactcagcctttcaatatgtttttggtcaaacttcatttaggcactagcatttagaagaataccaatcacagtgatgcttttgttatttaatatgaaggaaatggaactaaaacatttatgtcatcaaattttatttcacttctttatatttgacttgctggttgatacataatggttgatgaacatatatttgcttaaatcactaatagggatggttgtaaagtagatagatcattggttcaaccattttagtgtttttgccagattgtcaatgaaaccatcatactgaccttttcctccaaaattgccaaattgactgaactggttgggtgtttgtaaagatgacgttaactgtgtgactaaaaagtcagatggttgccatattgtttggaatatgttgaatgtcagtgtatgccttatgtctttaattgggtatgcaaaaaaatttttacttaagtagattaaaattttaacctctagcatgaaaacccagcaccaacactgaaagactccattcaggttgaagtagcctcaaacagtaatttactttttgataataggctgttgtttttcttaaataagcttaaaacaattctatctgaaattggtagcatgggttcacttggctacaactgagcaaaatagatgcaactttcttttaatggggtgctgcctctttaggactgactgtactatccactgacactggtttggcagttggtactgctgaacatttttatacatgctaccatgaagctatatatgttagtattgaagaagctaacgggtatactatcatttttgatgtgtgggctgattataatttcctgtatttcctgtacattgggatgaaactactttagcaaagtccacagatcagaaaccagacggtagtttttgaagttgaaaccagcaaaataagaaaaaataaaaaatcgattttaatattttctgcctctttcccaaattacccttcccacttgctcgacaaatctatgtaaagcagtttgttttttcatgttttaactttaccttgccctgtgttatggtactggctgacatgtctaagactggatgtgtatatttattatggtgtctaaaaatcatgaagttcatcacttttcaggagtatagataaaatcaaattggtagtacatcagagttacttttcagtgcaccatgacatcactaaaatgagtgctgtaatgttacagggctttcaggtttgtaaaaacataaccataaattatattgacgtcagatatgagttgagtatctataaaatatcacgtgtatctcaaaatattggactgctgtttgactggatattgctgcataattttcttctattgtcccatatccttttggagagagatttaatgggatttgaaatgtgcaagctgtctaaataagatgcagtcaaataaagtatggttaagttgtgtttgcatttttcttttagatacagctgtgtgcattttatgattgggttgttttgcttttacctactaagtaaaacagcaacaaacaatatattgtttcccgcttcctgcctttcatctaagagttacggggaagaagtattacataattgtcatcactgttgtgtgttctgacaaagtaaatttgaaaataacatgaacttgatttttctaaaagtactcagtcaactcatatgtcagttatcggtacattttccatgtgttcagtcaaaagtttatctttttagtctgtttcatagcagtttatttctaagacagtttttattttaatttacttttttgtctgtacactgccactctgtaatgttccccccaccccatcccacccttggtaagacaccaaagtaaaatagagcaatatccaaagagctttttgcccctgtcttgtgaggagctttaaatagctgtgaatacttctgtatgtcaagattttcggattttagtggaaggatgaaatgatctgttttaatcatttaactgctaaattacttttatcatgcatgccaaatctttacattattctttagagtaatactgtaaaagtatctgagtttgttttatttgggccttatgtggaactcgaaatacttcataaattcactctaaggtctaaataagaaccagaaggttgataccattttttcacaccagtaaacacagatcagtattaacctgtagcccagaggtgttagatttattttttgagacagagtctcactctgttgcccaggctggagtgcggtggcacaatcttggctcactgcaacctctgccccctgggttcaagcaattcttgtgccttagcctcctgagtagctgggactacaggtgcatgccaccacgcccagccaatttcttgtattcttagtatgagacagggtttcaccatgttggccaggctggtctcaaactcctgacctcaagtgatctgcccgcctcggcctcccaaagtgttggaattacaggcgtgagccaccacgcccagcctatgatattctttttataagcaacttttaaaaagttttttaaaagatctcataagcatatagcactgctacactttagatcactactgtccagtcacactttatataaggatagatgtgtccttttcactccccagtatggtagttactagtcacatgtgtagctactgagcccctgaagtgtgggtgggatgattgagctgaatttgtaattttaatcaaagttagccacatgtggcttgtggctactgtattggacagcagagctttagataagcagtaataacaggaagggagtgtttgtataggttgaaagataaaatggaaggatcacaattaggccagatgtggtggctcacgcctattatcccagcgttttgggaggctgagatggtagtttgcaaccagccaggacagcatagcaagactgtttctgaaaaatcttttaaaataacacaactaaaaattacctctgagcaagagtatagctgaactgtttatactgacaatatatttcattaatacagtgtttgaccactttccaccccaccaaccactgcccttgttatgtagcctttctgagaaaagcagccctttcagattttattgttggaagttccttgggttgcagagatgcagattcaagtgccaaaagttgtttctgatgagacttacctttttagccttaaaatatttgtatagttggctctaataatttctcatttttgatgaatttgaaatcatttcacttctaaatgagattggtcatctcatgagtggtcaagttggaacatggaggtctatcatgtttttaacctccaagatccacttatggggatgaggccaaaggccaatgttacttctagaagaaccagattaatttttctgccttccatcaccgcagtgtattacctttgaccctcgctggtcatctggtaagtgtagttcatcaaaagagcagaaataggcatagtaaacacctggacacaaagacagtgccaggcttggtacaacctgttaacactgttgaggaaagagctcaaaacatgcattactttggggattaagtcagtgtttaatctcaatatgaaacagacctagaaataacaaagaccactgaagtgccaaatttatcttctaatactactatttaaactatgcaatatgggggttataatgaaatagttttagtctatgtaaggtttttataatgctaagaaataagcttatttttagatatggattttttatgactacctctttgctgtatgaatatcttaattttctaatacctcagtttcatgagaactgtatgtacatttttgtaaataaaataatttaccatatactaggagaaggacctgcttttaaagaaattgtgtaaagacatttgttattggatgtgttacatagtaaatcaatttgaaatttcttaaaaacgtttataagacttttctggtctccttgaccgagggattttagtataagtatttagtgagatttgtattctaggaagtgtgtgccgtcacttgttcatttacaactgcaaagattgtatgtctcctatgttttcctttcatgccaaagaaactcaccctttttaaaagccagcaggttgcacaaaccaaaaacaaaatattttgccccttaaataggcattttaagaagttttatttcctggtacttaaatattgtgtagagggaaagctagttgtaataatttgtaaaaatgcgtgtatttttaggaatgcgctatttccagtaagggaagtattgacatttttaaggaactgtgctgcattaaaatccacagttgcatgaaacttttaaaagtttaagatataaagtaattgctaaaatttgtgaactactcagaggactcaatgccctaacatgtaggggattgatcattgcgatgtttaggccaggatttctcatgattgtatatggttattgatcatttttaaggggctgaacctgctgcctttatacttttgacacctccctccctccctccctccaaactgtggctgtaaacagtgactctgcatagtcagcgttatacttgatttctttgtgaatgcaaataaaataaaatttgtaagtccaccaaatattgacttaa

SEQ ID NO: 157173 - DNA, 2649 bp, Homo sapiens
  Payload ID: 10810
  Gene Symbol: NAA35
  Gene Name: N(alpha)-acetyltransferase 35, NatC auxiliary subunit
  Uniprot ID: Q5VZE5
  ENST ID: ENST00000361671
  CDS Start-End: 134-2311
atacgcatgcgtgcacgctgccggtcgggctgggctgagaggggagggggcggcggcggccgaggcggcgtcgttatttccgtggtccggacagtgcgtggcggcgcgggtgaccacgggagaagtaggcataatggttatgaaagcttctgtagatgatgacgattcaggatgggagctcagtatgccagaaaaaatggagaaaagcaatacaaactgggtggacattacccaagattttgaagaagcttgtcgagaattaaagttgggagaactacttcatgataagctatttggtctttttgaagccatgtctgctattgaaatgatggatcccaagatggatgctggcatgattggaaaccaagttaatcgaaaagttctcaattttgaacaagctatcaaggatggcactattaaaattaaagatctcaccttgcctgaactgatagggattatggatacatgtttttgctgtttgataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagaggaagattttcagtcaatgacttatggatttaaaatggctaacagtgtgacagatcttcgagttacaggcatgctaaaagatgtggaggatgacatgcaaagaagagtaaagagtactcgaagtcgacaaggagaagaaagagatccagaagttgaactagaacaccaacaatgtttagcagtattcagcagagtgaaatttactcgtgtgttactgacagtgcttatagcctttactaagaaagagaccagtgctgttgcagaagctcaaaaattgatggttcaagcagcagatcttctttctgccattcataattcattgcatcatggcatccaggcccagaatgatactacaaaaggagatcatccaattatgatgggttttgaaccccttgtgaaccagaggctacttccacctaccttccctcgatatgcaaaaataattaaaagggaagaaatggtgaactattttgcaagattaatagatagaataaaaactgtctgtgaggttgtgaatttaacaaatttacattgtatcctggattttttctgtgaatttagtgaacagtcaccatgtgttctttcaagatctctgttacaaaccactttcctggtggataacaaaaaggtctttggaactcatctcatgcaagacatggtgaaagatgcacttcggtcttttgtcagtcctccggtgctttcccccaagtgctacctatataataatcaccaggctaaggactgtatcgactcctttgttactcactgtgttcggccattctgtagtcttattcagatccatggacataacagggctcgacagagagataagcttggtcatattcttgaggaatttgccaccttgcaggatgaggcagagaaggttgatgcagcgcttcacaccatgctgttgaaacaggaaccccaaaggcaacatttggcctgtttaggtacctgggtcctttaccataaccttcgcattatgatacagtaccttctaagtggctttgaattggaactctacagtatgcacgagtactattacatatattggtatctctctgaattcctttacgcatggttgatgtcaacattgagtcgtgccgatggctctcaaatggcagaggaaaggataatggaagagcagcagaaaggccgtagtagtaaaaaaacaaagaaaaaaaagaaagttcgcccattgagccgagagatcacaatgagccaagcatatcagaacatgtgtgctggaatgtttaaaaccatggtagcatttgacatggacggcaaagtacgtaaaccgaagtttgagcttgatagtgaacaagttcggtatgaacacaggtttgctccattcaacagtgtgatgaccccgccgccagtgcactacttacagttcaaggaaatgtctgacctcaataaatatagccctcctcctcagtctcctgaactgtatgtggcagctagtaagcactttcaacaggcaaaaatgatattggaaaatattcctaacccggaccatgaggttaatagaattttaaaggttgccaaacccaactttgtggttatgaagttattggcaggaggacacaaaaaggaatctaaagttcctcctgaatttgatttctctgctcataaatattttcctgttgtgaaacttgtttgagagagactggggaggtggccataaaggggcagagtcttctttcagacccaactcttagagggcacatcaccaggctccacatcacgggaagtgagatggatttcttgggtaacaactcattataaggaatacttttagtttgacagccttatatgacatgaatgaaaactgctgttttaaagtggtttattatgttccatggaagaaactggtcttattgaatgcattgatgaacgttatatggttttattacagatttaatcacaaatcattttttatgaatgattgagtgaaaatagtgtttataaaggttaataaatttcttgacaaaaaaaaaa

SEQ ID NO: 157174 - DNA, 1797 bp, Homo sapiens
  Payload ID: 10810
  Gene Symbol: NAA35
  Gene Name: N(alpha)-acetyltransferase 35, NatC auxiliary subunit
  Uniprot ID: Q5VZE5
  ENST ID: ENST00000376040
  CDS Start-End: 352-1236
gcttatgcgcccagtgggaccggggctgggctgggctgacccgggcagggcggaagggaagcgtgtgcccgcctcaggtgtgcctcggccctaggcccggccggcgggaccctgcggtgcctgccggctcctcattgctcccggcgaggttctgcctgggtccgggccggctctggcccgggagaggtcccagcgagctctggccagatgaagggctaccttgattgacttcggtagctgccgcatggggtcctgggctgcgagaggggaccctgaatagtgccttggtcttttgtggctattattgaaagttggaagctctggagttgttcttttcgggccagaggcataatggttatgaaagcttctgtagatgatgacgattcaggatgggagctcagtatgccagaaaaaatggagaaaagcaatacaaactgggtggacattacccaagattttgaagaagcttgtcgagaattaaagttgggagaactacttcatgataagctatttggtctttttgaagccatgtctgctattgaaatgatggatcccaagatggatgctggcatgattggaaaccaagttaatcgaaaagttctcaattttgaacaagctatcaaggatggcactattaaaattaaagatctcaccttgcctgaactgatagggattatggatacatgtttttgctgtttgataacgtggttagaaggccattcactggcacagacagtatttacgtgcctttacattcataatccagactttatagaagatcctgctatgaaggcttttgctctgggaatcttgaaaatctgtgacattgcaagggaaaaagtaaataaagctgctgtttttgaagaggaagattttcagtcaatgacttatggatttaaaatggctaacagtgtgacagatcttcgagttacaggcatgctaaaagatgtggaggatgacatgcaaagaagagtaaagagtactcgaagtcgacaaggagaagaaagagatccagaagttgaactagaacaccaacaatgtttagcagtattcagcagagtgaaatttactcgtgtgttactgacagtgcttatagcctttactaagaaagagaccagtgctgttgcagaagctcaaaaattgatggttcaagcagcagatcttctttctgccattcataattcattgcatcatggcatccaggcccagaatgatactacaaaaggaggtctctgacatcttctagagatggaggtggaagtcagagataatgtgtaaaactgaaaagaaacgaaggagtactctaagcttgttttttgccaatgtgtagatcagaggtgtccaatcttttttttttgagacgaagtttcactattgttgcctaggctggagtgcaatggcgtgatctcggctcaatgcaacctctgcctcccgggttcaaatgattctcttacctcaccctcctgagtagctggaattacaggtgcctgtcaccatgcccggctaactttttgtattctttttttagtggagacggagtttcaccatgttggccaggctggtctcgaactcctgacctcaagtgatccgccctccttggccttccaaagtgctgggattacaggcgtgagccactgcgcctgaccggggtgtccaatcttttggcttcccagggccaccctggaagaagaattggtcttgcatcacacataaaatatgctaatgagagctgatgagccaaaaaaagaaaaaatcaccaaaacaaatctcataatgttttaataaagtttacaaact

SEQ ID NO: 157175 - DNA, 999 bp, Homo sapiens
  Payload ID: 10811
  Gene Symbol: NAA38
  Gene Name: N(alpha)-acetyltransferase 38, NatC auxiliary subunit
  Uniprot ID: Q9BRA0
  ENST ID: ENST00000333775
  CDS Start-End: 432-953
gcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggttagcacgggctctggttctgggactgaggggcagtcaagcagcaagatggagggggtggggaactgcagctcccggcagcctctgggctttgtgtgagtgccccgcgggctgccgggagctgtggttccgcgggcgggcagcctgggctgcgcggtctgagcgcttgttacaccccgcgcaggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 157176 - DNA, 529 bp, Homo sapiens
  Payload ID: 10811
  Gene Symbol: NAA38
  Gene Name: N(alpha)-acetyltransferase 38, NatC auxiliary subunit
  ENST ID: ENST00000575208
  CDS Start-End: 262-483
gtactcactactactacgacctccgtcgcgtccgggagccgaggggagagcgtttatccgctgacatggaaaccattgtccttttccggccaccgtccactgagataaatatcaggggcggggtttggactgcacgtgttcacgggaaacgtagtatgagtcccgcgtggggcatataaggatcaagattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 157177 - DNA, 424 bp, Homo sapiens
  Payload ID: 10811
  Gene Symbol: NAA38
  Gene Name: N(alpha)-acetyltransferase 38, NatC auxiliary subunit
  ENST ID: ENST00000576384
  CDS Start-End: 141-392
agctgtggttccgcgggcgggcagcctgggctgcgcggtctgagcgcttgttacaccccgcgcaggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcgggtcagtgcccggggaatgcacacccgcctgattccttctctgccggggagccccgtgtgctgggcctggccatggtacccggacaccacatcgtttccattgaggtgcagagggagagtctgaccgggcctccgtatctctgaccacgatggcgcttacctttcagacttcatta

SEQ ID NO: 157178 - DNA, 852 bp, Homo sapiens
  Payload ID: 10811
  Gene Symbol: NAA38
  Gene Name: N(alpha)-acetyltransferase 38, NatC auxiliary subunit
  Uniprot ID: Q9BRA0
  ENST ID: ENST00000575771
  CDS Start-End: 429-806
aattgagttgcgccgctttcaggagttgcggggtggggcagagaacgaatacgctccgttttaattcagtggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 157179 - DNA, 553 bp, Homo sapiens
  Payload ID: 10811
  Gene Symbol: NAA38
  Gene Name: N(alpha)-acetyltransferase 38, NatC auxiliary subunit
  ENST ID: ENST00000575071
  CDS Start-End: 100-507
cgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcgggtcagtgcccggggaatgcacacccgcctgattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaa

SEQ ID NO: 157180 - DNA, 556 bp, Homo sapiens
  Payload ID: 10811
  Gene Symbol: NAA38
  Gene Name: N(alpha)-acetyltransferase 38, NatC auxiliary subunit
  ENST ID: ENST00000576861
  CDS Start-End: 212-511
gagccccggattcgcgctccggattcgcctcggctcggccgcgcgtatatttgccttccctccatgatctccaacactatccgataaagtagaagcaactgaggtaccgtgaaagagaaaggagctggaactgagaaaaagcagagaaactgaaaggccaacgtgggagacaaagaagagcctgaaagagccaaatcttaccttctggaccatggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccga

SEQ ID NO: 157181 - DNA, 3664 bp, Homo sapiens
  Payload ID: 10812
  Gene Symbol: NAA40
  Gene Name: N(alpha)-acetyltransferase 40, NatD catalytic subunit
  Uniprot ID: Q86UY6
  ENST ID: ENST00000377793
  CDS Start-End: 102-815
agggccgtccgctctgctgccgccgctgttgcagccaccgccgttgccgcctccctgccggcaagtgtgtgaagaagaagctgagcgttgtcgccgccgctatggggagaaagtcaagcaaagccaaggagaagaagcagaagcggttggaggagcgagcagccatggatgccgtttgtgccaaagtggacgctgccaacaggcttggagaccctctggaggctttcccagtgttcaagaaatatgatagaaacgggttgaatgtctccattgaatgtaagcgagtgtctggactggagccagccaccgtggattgggccttcgacctgaccaaaacgaatatgcaaaccatgtatgagcagagcgagtggggctggaaggaccgagagaaacgggaggaaatgacagatgaccgagcctggtacctcatcgcgtgggaaaacagctccgtccctgttgccttttctcacttccggtttgacgtggagtgtggggatgaagtcctgtactgctatgaagtgcagttggaaagcaaggtgcggcggaaaggcctggggaagttcctcatacagatcctgcagctcatggccaacagcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctgcacgtgccaggctgcgccctgagagcacagaaccctggggagaagtggtatcagctgctcctcctctcctaggagaccagagtgctagaagggaatgaaagggagagggaagagtaggtggggccgggcagtgaagctcatcctccacagtggctgcctcctcatttggctcctggggcctgcagtggaggttctcgcacctctgcagcccctagattcctggcaacctcccctcccctgacacatacacacttggacaaatggaatgtttatgtccacctttatgaaagttctggagtcctgggtctggggtttgctggtccccaaagaggaacacactgggtgtaagatctgggtgtagagggcggcttcagagagactcacgcttgcgcagttggaattgctgttaacggagactgggaagatcttttgtgccaagatgcagggaaatgaagaaagctctttccagctgtttttatggattcatggagtgggctcatgttgggaccagctgactctgggaggaagactgcctctccatcgctgtcagagagcctgaaaggaccaacaatgaggtgttcttgggacccgccatggggatgattgcttctctaggctcctggatgttgctgcattctaagcttaacctcctggtctcatggcagtgacttgagcttttgattcatagaagaaagccagaggttctgcttgttcttgtctgccagccctcgtcgttctttctcctctgcctctcacctctaccccaaatacctctgttcttagtctcaaggggagaataacatcagggagcccctcatcttccccagaaggacttctcgttcctcatgtagttaactccattgattttcctatcttggtgctgatagctctctaagggtagggcacacctccccacagccaccctccctcttcagagagcccccagccagcagcaggcccctctgcctgcactcctcaggcttgcccctcgctgcctcagtgaggcactagtgccactgccgtggcccagccgggccatagctcaggctgcagcagaaatgcctctcagtggccaacagttgcttttctctctggtgtcaccctgtggcaacaggctggagcaggggaaggagaaagccttcctcttctctcataggatagaaaggcaggctcagaactaatgctcatcctgatctctaggccttgttcctcttccagggaagaaaagccaaatccttatcaaggaaaaagcacctaacagctccctttggatatccctgagctctgctgtggggagtatcataaaggttctagccttcgtgaagttgttctcgtggaggtctgttggtccctctgacctcagcatctgctcacatcccaccctctgcccaactctggcagtctctcctggcagatctccccagagtggtccttgcttctcacctggattcctgcttgtgcaggagcctgtgtacacagggcctccctcacccagcctggcccctctgctgagcactttgcgctgctcttgatgggcagcagtgggactgggaactccttagagagggccttgcagctttacactggaataagtctgcctctgcctctgcctcaccctgctggctcctggtgggtttcatcccaggcagagttgacattgctggaggggtttggtggactcctaagaatcatgaaaccacaggagcatgtttaggaagagatttgtctctggtccctgtctctgaaaggacacagatgctaaatatttattgtcttagatcatggattcctgatacctctcactcaaggggaccaaaagggacccccccgtgttcatcccttgtaaggtgagttcagtctacgttgtctctttccagtcactggatacgtggcaccaactggtcaatgggtgcttggtgccataccctgctcaccctagtctctgcaggccatgtcctgaagggttcctcaggaggtcgggactagggtgggagaggcactatctgagacctgcaatcactcttgttggtcttgagcccattcatttccaaaacatccatctttctccacttcccccaggtcttggttttgagaaacagcaggcatggctgagtgcggtggcttacacctgtaatcccagcactttgggaggctgaggcaggcgggtcacctgaggtcaggagttcaagaccagcctggtcaacatggcaaaagcccatctctactaaaaaatacaaaaatcagccaggcgtggttgtggcctgtaatcccagctactcgggaggctgaggcaggagactcgcttgaacccaggaggtggaggttgtggtgagctgagatcacgccattgcactccagcctaggcgacagagtgagactccatctcaaaaaaaaaaaaaagagaaacatagcaggccttttttaccaggctttttgtgttttgtttgtttgtttggagcatgttaagatttttttaagatttttaaaattttagttatatccaccctatttcaggttatttttgttggtgtcaagtatgtataggacatgtgaatggttctttttaatttttttttaagaggaaatttggaagataaactccttgatatatatatatatatatatatttttttttttctttagcagcttgttatcactggaatcaaagggaaaaagtgatctcttcttgcattggttgtatttgtatgtcacaaataaaagacactttggtcagctgctgag

SEQ ID NO: 157182 - DNA, 577 bp, Homo sapiens
  Payload ID: 10812
  Gene Symbol: NAA40
  Gene Name: N(alpha)-acetyltransferase 40, NatD catalytic subunit
  ENST ID: ENST00000539656
  CDS Start-End: 96-470
gtccgctctgctgccgccgctgttgcagccaccgccgttgccgcctccctgccggcaagtgtgtgaagaagaagctgagcgttgtcgccgccgctatggggagaaagtcaagcaaagccaaggagaagaagcagaagcggttggaggagcgagcagccatggatgccgtttgtgccaaagtggacgctgccaacaggcttggagaccctctggaggctttcccagtgttcaagaaatatgatagaaacggcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctg

SEQ ID NO: 157183 - DNA, 958 bp, Homo sapiens
  Payload ID: 10812
  Gene Symbol: NAA40
  Gene Name: N(alpha)-acetyltransferase 40, NatD catalytic subunit
  ENST ID: ENST00000534965
  CDS Start-End: 102-221
agggccgtccgctctgctgccgccgctgttgcagccaccgccgttgccgcctccctgccggcaagtgtgtgaagaagaagctgagcgttgtcgccgccgctatggggagaaagtcaagcaaagccaaggagaagaagcagaagcggttggaggagcgagcagccatggatgccgtttgtgccaaagtggacgctgccaacagggttgaatgtctccattgaatgtaagcgagtgtctggactggagccagccaccgtggattgggccttcgacctgaccaaaacgaatatgcaaaccatgtatgagcagagcgagtggggctggaaggaccgagagaaacgggaggaaatgacagatgaccgagcctggtacctcatcgcgtgggaaaacagctccgtccctgttgccttttctcacttccggtttgacgtggagtgtggggatgaagtcctgtactgctatgaagtgcagttggaaagcaaggtgcggcggaaaggcctggggaagttcctcatacagatcctgcagctcatggccaacagcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctgcacgtgccaggctgcgccctgagagcacagaaccctggggagaagtggtatcagctgctcctcctctcctaggagaccagagtgctaga

SEQ ID NO: 157184 - DNA, 808 bp, Homo sapiens
  Payload ID: 10812
  Gene Symbol: NAA40
  Gene Name: N(alpha)-acetyltransferase 40, NatD catalytic subunit
  ENST ID: ENST00000544138
  CDS Start-End: 96-305
gtccgctctgctgccgccgctgttgcagccaccgccgttgccgcctccctgccggcaagtgtgtgaagaagaagctgagcgttgtcgccgccgctatggggagaaagtcaagcaaagccaaggagaagaagcagaagcggttggaggagcgagcagccatggatgccgtttgtgccaaagtggacgctgccaacagggtgatgccaaacttaactctcctgggcctttccaccaaagccttcctcgcacatgtgacttcagagctaggcaaatggtgggttttgggaggctgctcctggttctgaagttagtctcccgttgtgggtccccacagcatcccactccaagacaacagctcttgggataggatctgcacctccgccccacttgtctgtgctgttcctcttttctttccctccacagcttggagaccctctggaggctttcccagtgttcaagaaatatgatagaaacggcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaaggcctttcctctttcctggtctcactgttcaccgggtgtcctcagagctgtggcctccccagccctgcacgt

SEQ ID NO: 157185 - DNA, 1035 bp, Homo sapiens
  Payload ID: 10812
  Gene Symbol: NAA40
  Gene Name: N(alpha)-acetyltransferase 40, NatD catalytic subunit
  Uniprot ID: Q86UY6
  ENST ID: ENST00000542163
  CDS Start-End: 345-995
attctaagggtccctacgctaggcctagcccgggaatcctctggagagcccctggtccggggccccaccccctcggcgcccccagcgtcacgcccgccccttcctgcttcgcggacccgttactggcctccccaccaccgtcccccgcggggaccctggggttagcttcccgctcccccagggtcactcatcacctggctgtcaccagcttcgtcgcttttcacatccgaggtcaaccctggcttggagggaattgaggcccagaggaaagaaggcgcctagccaagagaaagtcaagcaaagccaaggagaagaagcagaagcggttggaggagcgagcagccatggatgccgtttgtgccaaagtggacgctgccaacaggcttggagaccctctggaggctttcccagtgttcaagaaatatgatagaaacgggttgaatgtctccattgaatgtaagcgagtgtctggactggagccagccaccgtggattgggccttcgacctgaccaaaacgaatatgcaaaccatgtatgagcagagcgagtggggctggaaggaccgagagaaacgggaggaaatgacagatgaccgagcctggtacctcatcgcgtgggaaaacagctccgtccctgttgccttttctcacttccggtttgacgtggagtgtggggatgaagtcctgtactgctatgaagtgcagttggaaagcaaggtgcggcggaaaggcctggggaagttcctcatacagatcctgcagctcatggccaacagcacacagatgaagaaggttatgttaacagtatttaaacacaatcatggtgcctaccagttcttcagagaagcgttgcaatttgaaattgatgactcttcccccagcatgtccggttgctgtggggaggattgctcctatgagatcctgagccggaggaccaagtttggggacagccatcactcccacgcgggtgggcactgtggtggctgctgccactgaactctcagagccactttcaagtcacaatgctctctcctaa

SEQ ID NO: 157186 - DNA, 6135 bp, Homo sapiens
  Payload ID: 10813
  Gene Symbol: NAA50
  Gene Name: N(alpha)-acetyltransferase 50, NatE catalytic subunit
  Uniprot ID: Q9GZZ1
  ENST ID: ENST00000240922
  CDS Start-End: 326-835
cgcgccggcgcgcgaggggcggggtgaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctggtagtgatctgtgatatctgtaaatgtcaaaactgtattgttgaattctgcagccagcaaccgtacatactcattgtgtagtgtttcccttactgcttttatttactttcacatttaagatctaattttaaaatcattaaaataggccaagtgtaattaaggcatcctaattcagatcttctgtgacttgctaggtacagtgcccaatatctacaattcagttccaatgagagggaaaaagtaagatccaaggaactgtcttgctgctgtatttttaatgtaattattagaaatacttgacactttaggctgcaatctagttagtaatgtttattggctacagacaacatattcaggtgttttgtttttcttccttgtaaggaaggagtacggtagttcaatgagttgggaattggcttttaagctttttatcaaacatgaatttaagattttttctttaacagaattcagtatttaatatttctagtcaaaattgttataattagatttttgcttttttcatttaagaagcaatgagtgatccttgtctagtgtgtctcagttattactgtagtttaaaacaacaaacaagtattaccttccacagttctggatcaggaatctaggagctgcttaactgggtggttctgtcttgagatctcagaaggttgcagtcaagctgttagccaggactgtaccatcttgaagcttgacaaggctagaggagccatttccaagatgtcttgcttacgtggctcttgggcttctgttcctcactgtgtgggtatcacacacagtgcctgatgctcacgtggctcttgggcttcagttccttgggcaccagttgcctggtggacaactggtatgtggcttcccctagagcaggtgatataagaaagtgagcagaaaccatacttttttatgacgtagcctcaggtgacattatttctgccatattccatgagtcacacagaccaaccattgaatcagcttggtatagtgtgggaggggactgcacaaggatgtgaatactgggaggtggatatcattgggccctctaggagactggctatcactgctcagagaagatgctgggcttcgttgactcccaaggtcagggtagttttggttaggttgtgttttattagtctctaaaaggagtagttttctaaatgagggttataaagcactgcactttacagttattcgggatataaaagaaatagtgggtctaaaggctgtgctcttgtggttgggttttcagtggggaggggagactagtctgtctcagactgatgctgttctcactgatttgaatatttctgggaaattggatactacagtcacaaataggaacagtaagcctatagaagtttttcagggagtaaatattttctatggcagtgtcctgaattggttctcccttgcaagactgaactgtaggaacttagtcctagtttatgatacagccaagtaacatagtcacatgggaaaaagagcttgagtcagatttcttaatgtgtgttgttaacttggtagaacattgagaattatttaagtcagagaacgatctgttactggggcagaaattctcaaccttttcagttctccaaaatttaagatacttgatttcttaggtaaaatgtttttgtttttgttttggagacagagtctcgctctgtcgcccaggctggagtgcagtggcgcgatcttggctcactgcaaactccgcctcccagattcaagcaattctgcctgagcctcccaagtagctgcgactagaaagcgcatgccaccacgcctggctaattttttgtattttagtagagatgggggtttcaccgtgttgcccaggctggtctcaaactcctgagcttaggcaatcctcctggggcagcctcccaaagtgctaggattacaggcgagccatggcgcctggccagtaaaatgttttctatctagaatgaatcaaggtattttccttgctcagtagcttctagaataagaaaaaaatagcagcaagatctgattcagaaatagttgggagcagaaagttaatatgaaggagttgctacttgttaacagcctagagttgagatctagaagaattattacctttttaaatttgtgatgaaagcttaaatccagcatttgggaagttactctattggctgaactattttggagtttgtaagctttgtattagatattcctgatttaactgaaactaatttgccacatagctttaatttcatcccagttttacttgttttactgtcctcaaaaactcaagacatctgaactcaaaggatctaagcagtataaattaaagcacatgttgaatcactgtagctttcgtaggacatctgattataatgcttttctttgtttctttgtccatactgaacttgtctagtttatctttgagaaacatttgctagtatcaaaaatcttctgtaaagatttgaacaatcttgaattctccttgtcactagccatctcttcccctaaagtataataaaactgtcaggtacta

SEQ ID NO: 157187 - DNA, 1945 bp, Homo sapiens
  Payload ID: 10813
  Gene Symbol: NAA50
  Gene Name: N(alpha)-acetyltransferase 50, NatE catalytic subunit
  ENST ID: ENST00000477813
  CDS Start-End: 111-500
aggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggaggttggcgagctagcaaaacttggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaa

SEQ ID NO: 157188 - DNA, 1385 bp, Homo sapiens
  Payload ID: 10813
  Gene Symbol: NAA50
  Gene Name: N(alpha)-acetyltransferase 50, NatE catalytic subunit
  ENST ID: ENST00000497525
  CDS Start-End: 268-555
ggagggggcggaggcgaggctcgggctgttggcgggctgaagggccagcggagtagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcc

SEQ ID NO: 157189 - DNA, 962 bp, Homo sapiens
  Payload ID: 10813
  Gene Symbol: NAA50
  Gene Name: N(alpha)-acetyltransferase 50, NatE catalytic subunit
  ENST ID: ENST00000493900
  CDS Start-End: 352-858
cagtgcggctgcgcgtgaggcggcggcgcgccggcgcgcgaggggcggggtgaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccc

SEQ ID NO: 157190 - DNA, 958 bp, Homo sapiens
  Payload ID: 10813
  Gene Symbol: NAA50
  Gene Name: N(alpha)-acetyltransferase 50, NatE catalytic subunit
  ENST ID: ENST00000481432
  CDS Start-End: 301-447
gaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaaggatgtgctggagcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggacttt

SEQ ID NO: 157191 - DNA, 964 bp, Homo sapiens
  Payload ID: 10813
  Gene Symbol: NAA50
  Gene Name: N(alpha)-acetyltransferase 50, NatE catalytic subunit
  ENST ID: ENST00000493454
  CDS Start-End: 374-661
tatattctgcctctgtcagaaacttgttctccaactccagaggcttcttacctcagtcccctatagtgctgtagtgaatgcttgttcataaaactacctgacacacatccttaattacttcttttggataatttcctaagaatgaattttctggatcaaaagccggatcgagctgggagatgtgacaccacacaatattaaacagttgaaaagattgaatcaggtcatctttccagtcagctacaatgacaagttctacaaggatgtgctggaggttggcgagctagcaaaacttgcctatttcaatgatattgctgtaggtgcagtatgctgtagggtggatcattcacagaatcagaagagactttacatcatgacactaggatgtctggcaccttaccgaaggctaggaataggaactaaaatgttaaatcatgtcttaaacatctgtgaaaaagatggtacttttgacaacatttatctgcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaa

SEQ ID NO: 157192 - DNA, 789 bp, Homo sapiens
  Payload ID: 10813
  Gene Symbol: NAA50
  Gene Name: N(alpha)-acetyltransferase 50, NatE catalytic subunit
  ENST ID: ENST00000497255
  CDS Start-End: 282-458
gcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggccggatcgagctgggagatgtgacaccacacaatattaaacagttgaaaagattgaatcaggtcatctttccagtcagctacaatgacaagttctacaaggatgtgctggagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaaggg

SEQ ID NO: 157193 - DNA, 473 bp, Homo sapiens
  Payload ID: 10813
  Gene Symbol: NAA50
  Gene Name: N(alpha)-acetyltransferase 50, NatE catalytic subunit
  ENST ID: ENST00000478020
  CDS Start-End: 301-473
gaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggccggatcgagctgggagatgtgacaccacacaatattaaacagttgaaaagattgaatcaggtcatctttccagtcagctacaatgacaagttctacaaggatgtgctggaggttggcgagctagcaaaacttggtgcagtatgctgtagggtggatcattcaca

SEQ ID NO: 157194 - DNA, 3257 bp, Homo sapiens
  Payload ID: 10813
  Gene Symbol: NAA50
  Gene Name: N(alpha)-acetyltransferase 50, NatE catalytic subunit
  ENST ID: ENST00000616174
  CDS Start-End: 246-491
agagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaaggtagccggatcgagctgggagatgtgacaccacacaatattaaacagttgaaaagattgaatcaggtcatctttccagtcagctacaatgacaagttctacaagaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctggt

SEQ ID NO: 157195 - DNA, 177 bp, Homo sapiens
  Payload ID: 10813
  Gene Symbol: NAA50
  Gene Name: N(alpha)-acetyltransferase 50, NatE catalytic subunit
  ENST ID: ENST00000630058
  CDS Start-End: 1-177
atgggtagccggatcgagctgggagatgtgacaccacacaatattaaacagttgaaaagattgaatcaggtcatctttccagtcagctacaatgacaagttctacaaggatgtgctggagaaaaacctcaaagttccttctggtcagaatgcagatgtgcaaaagacagacaactga

SEQ ID NO: 157196 - DNA, 2522 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000360862
  CDS Start-End: 275-808
tccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattgg

SEQ ID NO: 157197 - DNA, 2735 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000407558
  CDS Start-End: 304-1032
aaccgaggacctgtagccactgggcagctgcgagaggtagttttcctccttttctctaagcaaccatttccgcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcggtaacaaaatcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattggagttcgtcaca

SEQ ID NO: 157198 - DNA, 2619 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000414063
  CDS Start-End: 177-905
agggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattgg

SEQ ID NO: 157199 - DNA, 1149 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000424546
  CDS Start-End: 86-835
gcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcgcatacagaaaggctgtacctggaggaaggaagtgcggagccagcctgagttgggagaagagctccagagagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccgtccccagggctgacccagtgtggctgcattcact

SEQ ID NO: 157200 - DNA, 1045 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000421765
  CDS Start-End: 204-776
aatgggcttccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcatagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggctcttcagctcccctccctgcttctggaaacctctgcctgctgccctggccctgcccccctgcgcatgcaccgtccccagggctgacccagtgtggctgcattcactggga

SEQ ID NO: 157201 - DNA, 657 bp, Homo sapiens
  Payload ID: 10814
  Gene Symbol: NAA60
  Gene Name: N(alpha)-acetyltransferase 60, NatF catalytic subunit
  ENST ID: ENST00000573201
  CDS Start-End: 360-657
ggggtctcctccgtgagctccgggcctgtttgcctgctgaagtagagtcttagggtgaccccagggggacgtaatgtttccgagaagaaggacagaaagaagactgggagacaccggaactcgaaagaaaatcggtaacaaaatatggtactgccttttaaggtctattacttaaacataagtatggctctggttcttaccgcctttaccgtatccttcatgggaagttgatactgatcggaaactgacacagagccttctcacctacactaagggggcctagcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaa

SEQ ID NO: 157202 - DNA, 575 bp, Homo sapiens
  Payload ID: 10814
  Gene Symbol: NAA60
  Gene Name: N(alpha)-acetyltransferase 60, NatF catalytic subunit
  ENST ID: ENST00000577013
  CDS Start-End: 59-463
aggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactg

SEQ ID NO: 157203 - DNA, 2531 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000575076
  CDS Start-End: 111-839
ataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattgg

SEQ ID NO: 157204 - DNA, 608 bp, Homo sapiens
  Payload ID: 10814
  Gene Symbol: NAA60
  Gene Name: N(alpha)-acetyltransferase 60, NatF catalytic subunit
  ENST ID: ENST00000573345
  CDS Start-End: 112-237
cataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccatt

SEQ ID NO: 157205 - DNA, 582 bp, Homo sapiens
  Payload ID: 10814
  Gene Symbol: NAA60
  Gene Name: N(alpha)-acetyltransferase 60, NatF catalytic subunit
  ENST ID: ENST00000572169
  CDS Start-End: 256-582
agttttcctccttttctctaagcaaccatttccgcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcgcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaag

SEQ ID NO: 157206 - DNA, 758 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000573580
  CDS Start-End: 208-741
gtgagctccgggcctgtttgcctgctgaagtagagtcttagggtgaccccagggggacgtaatgtttccgagaagaaggacagaaagaagactgggagacaccggaactcgaaagaaaatcggtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccg

SEQ ID NO: 157207 - DNA, 2450 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000572584
  CDS Start-End: 53-781
aagaccaggctgtgaggtgacgcgtcccccccacccttccccacaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacga

SEQ ID NO: 157208 - DNA, 565 bp, Homo sapiens
  Payload ID: 10814
  Gene Symbol: NAA60
  Gene Name: N(alpha)-acetyltransferase 60, NatF catalytic subunit
  ENST ID: ENST00000573593
  CDS Start-End: 177-565
aagcaaccatttccgcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcggtaacaaaatgtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccagga

SEQ ID NO: 157209 - DNA, 570 bp, Homo sapiens
  Payload ID: 10814
  Gene Symbol: NAA60
  Gene Name: N(alpha)-acetyltransferase 60, NatF catalytic subunit
  ENST ID: ENST00000576787
  CDS Start-End: 340-570
acataactcgttgcgggctccgcgcggtcccacttcccggctcccttcgcctccaggatgcgctgagccctacaacacccccagcggccgccggctcccccacgagtgaaccagatgctgcccccctgcggttccagtgtatgtcagtgccagccacgtgcccaggacccaccgttcccagggatacaagatcccgtggcccatggtggcagctgcggcacacagcgctgctttccagagctctcagtgcggacaacagaggccttgcattcagtcacctggaaaacccaccatccacattggaaacccagtctctccggaatgagaaatttggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaata

SEQ ID NO: 157210 - DNA, 584 bp, Homo sapiens
  Payload ID: 10814
  Gene Symbol: NAA60
  Gene Name: N(alpha)-acetyltransferase 60, NatF catalytic subunit
  ENST ID: ENST00000574950
  CDS Start-End: 265-584
gtgagctccgggcctgtttgcctgctgaagtagagtcttagggtgaccccagggggacgtaatgtttccgagaagaaggacagaaagaagactgggagacaccggaactcgaaagaaaatcggtaacaaaatgtgggttcggccaacagtgccctgtaggcctgaaatttcggtctggccagagcaagcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagtt

SEQ ID NO: 157211 - DNA, 552 bp, Homo sapiens
  Payload ID: 10814
  Gene Symbol: NAA60
  Gene Name: N(alpha)-acetyltransferase 60, NatF catalytic subunit
  ENST ID: ENST00000574328
  CDS Start-End: 193-552
aaaaggagaagatggcagagtaggacaatggatactaggggacagtttgacacgcagactcaaatctttttttttttagatggagttttgcttttgtcgcgcaggctggagtgcagtggcgcaatctcggctcactgcagcctccacctccagggttcaaacgattctcctgcctcagcctcccaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagttta

SEQ ID NO: 157212 - DNA, 818 bp, Homo sapiens
  Payload ID: 10814
  Gene Symbol: NAA60
  Gene Name: N(alpha)-acetyltransferase 60, NatF catalytic subunit
  ENST ID: ENST00000572757
  CDS Start-End: 395-818
agttttcctccttttctctaagcaaccatttccgcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcgatggtactgccttttaaggtctattacttaaacataagtatggctctggttcttaccgcctttaccgtatccttcatgggaagttgatactgatcggaaactgacacagagccttctcacctacactaagggggcctagcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaaggatcacatatcaaccaccgcccaggaccactgcaaagccatttacctgcatgtcctcacca

SEQ ID NO: 157213 - DNA, 558 bp, Homo sapiens
  Payload ID: 10814
  Gene Symbol: NAA60
  Gene Name: N(alpha)-acetyltransferase 60, NatF catalytic subunit
  ENST ID: ENST00000572131
  CDS Start-End: 196-558
taactcgttgcgggctccgcgcggtcccacttcccggctcccttcgcctccaggatgcgctgagccctacaacacccccagcggccgccggctcccccacgagaaaagtgcactgcttgatgagttgacatggcatgaacataacctgtacatccccaacgccagaagacccatgggcccccttaccaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcataggttccctcttacttgaaagtttaaag

SEQ ID NO: 157214 - DNA, 833 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000570819
  CDS Start-End: 59-598
aggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcatagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggctcttcagctcccctccctgcttctggaaacctctgcctgctgccctggccctgcccccctgcgcatgcaccgtccccagggctgacccagtgtggctgcattcactgggaggggcctgccctcactgggcctctcc

SEQ ID NO: 157215 - DNA, 803 bp, Homo sapiens
  Payload ID: 10814
  Gene Symbol: NAA60
  Gene Name: N(alpha)-acetyltransferase 60, NatF catalytic subunit
  ENST ID: ENST00000572739
  CDS Start-End: 118-381
cggttacataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccg

SEQ ID NO: 157216 - DNA, 700 bp, Homo sapiens
  Payload ID: 10814
  Gene Symbol: NAA60
  Gene Name: N(alpha)-acetyltransferase 60, NatF catalytic subunit
  ENST ID: ENST00000575733
  CDS Start-End: 422-700
gctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcggtaacaaaatgtgggttcggccaacagtgccctgtaggcctgaaatttcggtctggccagagcaagatggtactgccttttaaggtctattacttaaacataagtatggctctggttcttaccgcctttaccgtatccttcatgggaagttgatactgatcggaaactgacacagagccttctcacctacactaagggggcctagcatacagaaaggctgtacctggaggaaggaagtgcggagccagcctgagttgggagaagagctccagagagtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacaca

SEQ ID NO: 157217 - DNA, 398 bp, Homo sapiens
  Payload ID: 10814
  Gene Symbol: NAA60
  Gene Name: N(alpha)-acetyltransferase 60, NatF catalytic subunit
  ENST ID: ENST00000570372
  CDS Start-End: 158-398
tttccgcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagagg

SEQ ID NO: 157218 - DNA, 1567 bp, Homo sapiens
  Payload ID: 10814
  Gene Symbol: NAA60
  Gene Name: N(alpha)-acetyltransferase 60, NatF catalytic subunit
  ENST ID: ENST00000576916
  CDS Start-End: 111-515
ataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagtggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatca

SEQ ID NO: 157219 - DNA, 1089 bp, Homo sapiens
  Payload ID: 10814
  Gene Symbol: NAA60
  Gene Name: N(alpha)-acetyltransferase 60, NatF catalytic subunit
  Uniprot ID: Q9H7X0
  ENST ID: ENST00000572942
  CDS Start-End: 111-650
ataactcgttgcgggctccgcgcggtcccacttcccggctcccttcgcctccaggatgcgctgagccctacaacacccccagcggccgccggctcccccacgaggtgtgaatgacagaggtggtgccatccagcgcgctcagcgaggtcagcctgcgcctcctctgccacgatgacatagacactgtgaagcacctgtgtggcgactggttccccatcgagtacccagactcatggtatcgtgatatcacatccaacaagaagttcttttcccttgctgcaacctacagaggtgccattgtgggaatgatagtagctgaaattaagaacaggaccaaaatacataaagaggatggagatattctagcatccaacttctctgttgacacacaagtcgcgtacatcctaagtctgggcgtcgtgaaagagttcaggaagcacggcatagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggg

SEQ ID NO: 157220 - DNA, 326 bp, Homo sapiens
  Payload ID: 10814
  Gene Symbol: NAA60
  Gene Name: N(alpha)-acetyltransferase 60, NatF catalytic subunit
  ENST ID: ENST00000615865
  CDS Start-End: 34-180
agtagagtcttagggtgaccccagggggacgtaatgtttccgagaagaaggacagaaagaagactgggagacaccggaactcgaaagaaaatcgcatacagaaaggctgtacctggaggaaggaagtgcggagccagcctgagttgggagaagagctccagagatgtgaaaacagactaatacatcgtctcaaaaaaagagaaaagaagaagaaggaactaaagaagaatttctttggaagcaaaatatttggaagcaaaatatttggctcctgactgaaagggttttgatccatgcatacattaataaacccttcagaaccatga

SEQ ID NO: 157221 - DNA, 4781 bp, Homo sapiens
  Payload ID: 10815
  Gene Symbol: N6AMT1
  Gene Name: N-6 adenine-specific DNA methyltransferase 1 (putative)
  Uniprot ID: Q9Y5N5
  ENST ID: ENST00000351429
  CDS Start-End: 27-587
acgcgcatggaacgcagcgaaggactatggcaggggagaacttcgctacgccgttccacgggcacgtgggccgcggcgccttcagcgacgtgtacgagcccgcggaggacacgtttctgcttttggacgcgctggaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtaggaagtcacggaatagaggcagcttgggctggtggcagaaatggtcgggaagtcatggacaggttttttcccctggttccagatctcctttcaccaagaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattatatttatagtttgcattttaaatataaaaattatgtatgaaatatttatttcagcattatgtggtaaggcaatggaattgatctggcaaatgtcttttttttcataccagtccataaaggcagtttgctttcagatggcagggccagcaacacaccttcattgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggatccagtgacatggggcatgttaggatatttcttctacggtgaaggataagtacttgcatcttgctgctcttaaaaccaagaaagaggcacaatacttagtgggcctctttgggttttggaggcaacattttccaatttcattatgttataccagcctgtttaccaattgactcaaaaagctgctagttttgagtagggcccagaacaagaaaagagtctgcaacaggtccaggctgctgtgcaagctgctctgccacttgggtcatatgatccagcagatccagtggtgtttcagtggcagtggcagatagggatgctgtttgaagcttctggcaggtccctataggtgaatcttggtttaggattttagagcaaagccgtgccattaccaacaaataactagtctctttttgagaaacagctcttggcctgctactgggccttagtagagactgatacttaatgagtcaccaagttaccgtgcaacctgagcttcccatcatgaactggatgttatctgagccaccaacgcacaaagttggatatgcacagcaacactctgtcatcagatggaagtggtatacacatgattgggcctgagaggccctgaaggcacaaggaagttacatgaagaagtaggccaaatttccgtagtccccacttctgctacctgccttctctcttccagcctgcatcggtggcttcatggggacttccctgtgatcagctgacagagaaagagaagacttaggcctggtttacagagtgttctgtatgatatgcaggtaccaccctaaagtggatagctgcagcactacatctcacctctgggctaccttgaaggacagtggtgaagggaaatcctcctggtggacacaactttgagcagtccccctgttgactttgcttagaaggaaaaatagccagatattcaattatatgccaattcataggccgtggccagtggtttggctggatggtcagggagttcaatataactggaaaattggtgacaaagaaatttggagatgaagtatgtggatagacactgaatgggcaaaaagggtgaagatatttgtgccccatgtgaatgctcaccaaagggttagcaaaaaaggattttaataaagtggacaagataacctgttctgtggatactagtaggcctctttctccagccacacctgtcatcacccaattgtttcatgagcaaagtagccatggtgacaagaatagaggttatgcatgggctcagcaacgtggacttctactcaccaaggctgacctggccaaggctatctctgagtgcccagtctgccagcaacagagaccaacactgagcccctgatatgacaccattccccagggtcatcagtcagttgcctagtggcaggttcattacattgatccacctctatcattgaagggatagtgttttatccttactgaaatagatcttactctggatacagattcactttcccttcgcgcagggtgtctgctaaaactaccatccgtggacttacagaatgtctcatctatgaccatggtattccacacagcattacaagaaactcagttcacagcaaaagtgtggcagtgggcccatgatcatggaattttcttaccatgttccctactatcttgaatcaactggctacatagagcagtggaatggcattttgaagacagtaataacaccagctatatagcagtgccttgtagggctgggacaaggttctctagaagactgtctatgctctgaatcaacatccagtatatggtgcatttctcttatgactgggattcacaggtccaggaatcaaggggtcagaataggaaggacaccattcgctattagccctggtgacccactagcaaaatttttgcttcctgttcccatgacttatgcactgctggcctagaggtcttacatagggtggaatattttccactgagagacgcaatcatgatttaattgaactggaagtttaagactgctcctcagccatttggggcttcttatgcctctaactcaatagacaaatgagttacagtgctggctgggtgattgttcctgactaccaagtagaaactggactaccccgaatggtggtaaggtaaagtatgttgggaatacacaggattccttagggcatctcttagtgttatcatgccctgtgattaaggtcaatggaaaactacagcctaattcagacaggaccactaatgatccagacctttcaggaatgaaggtttgggtcaccaccaggtaagtaccatgaccagatgaagtgcttgctgaaggcaaagggaatacagaataaatggtggaataaatactagctttgatcatatgaccagttacagaaacacagactgtgattgtcataagtatgtcctccatattttgctataactacattttgtgtgtgtgtagctttgttttcttctcatttccttattctgtaacataagatgcattgattttatagcatagtgtttaaatattgttaatttttttaactggctccagtgttcaaccttgattaattttacatcatagtatttaagttatgggatatcaaggagagagtaaacatcacatgaagactttaccacctcttctgggaaacgggttagagtgtttctggtggaatgctggattgttaatcgtgttagatggaattatgaccttgttgttgtctttatgtggcagttaagtatggtttaaagagatgtttatgggtgccaagttgacaagggtaaacttgtgatggttaattttatatgtcaacttgaataggccacagggtgccaaatatctgtttaaacattattctgaagtgtcttgagtgtgtttacagacaagatttgcatttgaactgggggactcagtaaaggagatagccatccccaaggtgggtggacatcatccagtttgttgagggcgtaaataaaataaaaggcagaggaaggaagaattccccccccttttttttcctgcctcattgtttgagctgtgacatctcatcttctgtcctcagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattagaccaatctataaaacagctagctatgaaagagaaaggtgacaggcacaagcctaggcaaatagagaagggttcctggagagcctctgacttgcctaggtcattgtgcacacgtggcttgcctgaatgaacatgcccactgtgaaagattccatttctcaacacatgtgcagtaagggaaataaatcaatgtggctcagactaagcgcccacacatggggtggagccacgaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgcc

SEQ ID NO: 157222 - DNA, 4865 bp, Homo sapiens
  Payload ID: 10815
  Gene Symbol: N6AMT1
  Gene Name: N-6 adenine-specific DNA methyltransferase 1 (putative)
  ENST ID: ENST00000303775
  CDS Start-End: 27-671
acgcgcatggaacgcagcgaaggactatggcaggggagaacttcgctacgccgttccacgggcacgtgggccgcggcgccttcagcgacgtgtacgagcccgcggaggacacgtttctgcttttggacgcgctggaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtcaaaggcttgctaccaagattgaccgaaaaagttgatcttctggtgtttaatcccccctatgtagtgactccacctcaagaggtaggaagtcacggaatagaggcagcttgggctggtggcagaaatggtcgggaagtcatggacaggttttttcccctggttccagatctcctttcaccaagaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattaggtaacaaggaattttatcagaaatttgtcattaaaaaaaggtagaaaggtggaacattccctttcagtcaggcctatagaattatttgcacaagtacaagtaaatatgtgtattatatttatagtttgcattttaaatataaaaattatgtatgaaatatttatttcagcattatgtggtaaggcaatggaattgatctggcaaatgtcttttttttcataccagtccataaaggcagtttgctttcagatggcagggccagcaacacaccttcattgtcgtatctccggtgtgtatcagctctccaactctatgtcataattcagttcatggggatcttgattacctttcccttccacaaaatattacactgattggttatatcgatgacattatgctgatttgacctagtgagcaagaagtaggaactacattagacttagtggaaagacatttgcatcagagggtaggaaataaatatgactacaattcaagggccttctaccttagtgaaattggtagggatccagtgacatggggcatgttaggatatttcttctacggtgaaggataagtacttgcatcttgctgctcttaaaaccaagaaagaggcacaatacttagtgggcctctttgggttttggaggcaacattttccaatttcattatgttataccagcctgtttaccaattgactcaaaaagctgctagttttgagtagggcccagaacaagaaaagagtctgcaacaggtccaggctgctgtgcaagctgctctgccacttgggtcatatgatccagcagatccagtggtgtttcagtggcagtggcagatagggatgctgtttgaagcttctggcaggtccctataggtgaatcttggtttaggattttagagcaaagccgtgccattaccaacaaataactagtctctttttgagaaacagctcttggcctgctactgggccttagtagagactgatacttaatgagtcaccaagttaccgtgcaacctgagcttcccatcatgaactggatgttatctgagccaccaacgcacaaagttggatatgcacagcaacactctgtcatcagatggaagtggtatacacatgattgggcctgagaggccctgaaggcacaaggaagttacatgaagaagtaggccaaatttccgtagtccccacttctgctacctgccttctctcttccagcctgcatcggtggcttcatggggacttccctgtgatcagctgacagagaaagagaagacttaggcctggtttacagagtgttctgtatgatatgcaggtaccaccctaaagtggatagctgcagcactacatctcacctctgggctaccttgaaggacagtggtgaagggaaatcctcctggtggacacaactttgagcagtccccctgttgactttgcttagaaggaaaaatagccagatattcaattatatgccaattcataggccgtggccagtggtttggctggatggtcagggagttcaatataactggaaaattggtgacaaagaaatttggagatgaagtatgtggatagacactgaatgggcaaaaagggtgaagatatttgtgccccatgtgaatgctcaccaaagggttagcaaaaaaggattttaataaagtggacaagataacctgttctgtggatactagtaggcctctttctccagccacacctgtcatcacccaattgtttcatgagcaaagtagccatggtgacaagaatagaggttatgcatgggctcagcaacgtggacttctactcaccaaggctgacctggccaaggctatctctgagtgcccagtctgccagcaacagagaccaacactgagcccctgatatgacaccattccccagggtcatcagtcagttgcctagtggcaggttcattacattgatccacctctatcattgaagggatagtgttttatccttactgaaatagatcttactctggatacagattcactttcccttcgcgcagggtgtctgctaaaactaccatccgtggacttacagaatgtctcatctatgaccatggtattccacacagcattacaagaaactcagttcacagcaaaagtgtggcagtgggcccatgatcatggaattttcttaccatgttccctactatcttgaatcaactggctacatagagcagtggaatggcattttgaagacagtaataacaccagctatatagcagtgccttgtagggctgggacaaggttctctagaagactgtctatgctctgaatcaacatccagtatatggtgcatttctcttatgactgggattcacaggtccaggaatcaaggggtcagaataggaaggacaccattcgctattagccctggtgacccactagcaaaatttttgcttcctgttcccatgacttatgcactgctggcctagaggtcttacatagggtggaatattttccactgagagacgcaatcatgatttaattgaactggaagtttaagactgctcctcagccatttggggcttcttatgcctctaactcaatagacaaatgagttacagtgctggctgggtgattgttcctgactaccaagtagaaactggactaccccgaatggtggtaaggtaaagtatgttgggaatacacaggattccttagggcatctcttagtgttatcatgccctgtgattaaggtcaatggaaaactacagcctaattcagacaggaccactaatgatccagacctttcaggaatgaaggtttgggtcaccaccaggtaagtaccatgaccagatgaagtgcttgctgaaggcaaagggaatacagaataaatggtggaataaatactagctttgatcatatgaccagttacagaaacacagactgtgattgtcataagtatgtcctccatattttgctataactacattttgtgtgtgtgtagctttgttttcttctcatttccttattctgtaacataagatgcattgattttatagcatagtgtttaaatattgttaatttttttaactggctccagtgttcaaccttgattaattttacatcatagtatttaagttatgggatatcaaggagagagtaaacatcacatgaagactttaccacctcttctgggaaacgggttagagtgtttctggtggaatgctggattgttaatcgtgttagatggaattatgaccttgttgttgtctttatgtggcagttaagtatggtttaaagagatgtttatgggtgccaagttgacaagggtaaacttgtgatggttaattttatatgtcaacttgaataggccacagggtgccaaatatctgtttaaacattattctgaagtgtcttgagtgtgtttacagacaagatttgcatttgaactgggggactcagtaaaggagatagccatccccaaggtgggtggacatcatccagtttgttgagggcgtaaataaaataaaaggcagaggaaggaagaattccccccccttttttttcctgcctcattgtttgagctgtgacatctcatcttctgtcctcagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattagaccaatctataaaacagctagctatgaaagagaaaggtgacaggcacaagcctaggcaaatagagaagggttcctggagagcctctgacttgcctaggtcattgtgcacacgtggcttgcctgaatgaacatgcccactgtgaaagattccatttctcaacacatgtgcagtaagggaaataaatcaatgtggctcagactaagcgcccacacatggggtggagccacgaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgcc

SEQ ID NO: 157223 - DNA, 1293 bp, Homo sapiens
  Payload ID: 10815
  Gene Symbol: N6AMT1
  Gene Name: N-6 adenine-specific DNA methyltransferase 1 (putative)
  ENST ID: ENST00000460212
  CDS Start-End: 27-671
acgcgcatggaacgcagcgaaggactatggcaggggagaacttcgctacgccgttccacgggcacgtgggccgcggcgccttcagcgacgtgtacgagcccgcggaggacacgtttctgcttttggacgcgctggaggcagcggctgccgaactggcaggagtggaaatatgcctggaagtagggtcagggtctggtgtagtatctgcattcctagcctctatgataggccctcaggctttgtacatgtgcactgatatcaaccctgaggcagcagcttgtaccctagagacagcacgctgtaacaaagttcacattcaaccagttattacagatttggtcaaaggcttgctaccaagattgaccgaaaaagttgatcttctggtgtttaatcccccctatgtagtgactccacctcaagaggtaggaagtcacggaatagaggcagcttgggctggtggcagaaatggtcgggaagtcatggacaggttttttcccctggttccagatctcctttcaccaagaggattattctatttagttaccattaaagaaaacaacccagaagaaattttgaaaataatgaagacaaaaggtctgcaaggaaccactgcactttccagacaagcaggccaagaaactctttcagtcctcaagttcaccaagtcttagcatacagtgtgtgcccagaactactggaaactgaatgcatttagcatattttgaaactgaagtcattcattagatggatttacatcactggcttccctggttctcaagcctttggattcagactgaattataccacaggccttcctgggtctccagcttatagatgacagatcatgggacctcttagcctccataatcatgtaagccactttcttgtagtactggtaaaagatatattagaccaatctataaaacagctagctatgaaagagaaaggtgacaggcacaagcctaggcaaatagagaagggttcctggagagcctctgacttgcctaggtcattgtgcacacgtggcttgcctgaatgaacatgcccactgtgaaagattccatttctcaacacatgtgcagtaagggaaataaatcaatgtggctcagactaagcgcccacacatggggtggagccacgaggagtttgctccttatgcaggggagaagccgtgcctcttcagctcgtgtgtggtggcctggcattcaatttgtgaggtgtaaaacctgcatgaaggacccctctttttgtggagagctttccttttgcctaataaattctgccctcctcgcc

SEQ ID NO: 157224 - DNA, 875 bp, Homo sapiens
  Payload ID: 10816
  Gene Symbol: N6AMT2
  Gene Name: N-6 adenine-specific DNA methyltransferase 2 (putative)
  Uniprot ID: Q8WVE0
  ENST ID: ENST00000382754
  CDS Start-End: 82-726
gagtggcgggttcgggcgcagctgtagggttggctgcgcgccgccgaggcgttttggactgggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttca

SEQ ID NO: 157225 - DNA, 1042 bp, Homo sapiens
  Payload ID: 10816
  Gene Symbol: N6AMT2
  Gene Name: N-6 adenine-specific DNA methyltransferase 2 (putative)
  Uniprot ID: Q8WVE0
  ENST ID: ENST00000382758
  CDS Start-End: 49-693
gagtctgggcgactgcgcacgcgcggctggttataaacaacttgtgaaatgagtgatttggaagatgatgagacaccccagctttctgcccatgccttagcagctctccaggaattttatgctgagcaaaagcaacaaattgagccaggcgaggatgataaatataacattggaataatagaagagaattggcaactgagccagttttggtatagtcaggaaactgctctgcagctggcacaggaggcaattgcagctgtaggagaaggtggcagaatcgcatgtgtgagtgcccctagtgtttaccagaaactcagagagctgtgcagagaaaacttttcgatatacatctttgaatatgacaaaagatttgccatgtatggagaggagtttattttctatgattacaataatccattggacttacccgaaagaattgctgcacatagttttgacatcgtaatagcagatcctccctatctttcggaggaatgtctcagaaaaacatcggaaaccgtcaagtacctgacgcggggcaagattctgctgtgcacaggtgccatcatggaagaacaggcagcagaactccttggagtgaagatgtgcacgtttgttccaagacacacccggaacttggcaaatgagtttcgctgttatgtgaattatgattctgggctggactgtgggatctgattacagacggtgacataacacaggaaggaaccctgtcacattcctctttttgtattttcgtagtagatttaaaagttataatctcttcccctccccccaaactggagctgtccctggcctggttttcaaaataaagtgtgcgatcttcattattgtttccttagggagggcgtccctagagctcagtcttctgccaacctgaatccatggaattcgagttggaagaaaccttagaatctgcctgatcttctctcctcatttaacatgtgtaaaaacagaagaacagttgtgtggcttgcccaagggctcctgaatgagacaggaccttggcctctgcctcgggccagag

SEQ ID NO: 157226 - DNA, 2589 bp, Homo sapiens
  Payload ID: 10817
  Gene Symbol: NKAIN1
  Gene Name: Na+/K+ transporting ATPase interacting 1
  Uniprot ID: Q4KMZ8
  ENST ID: ENST00000373736
  CDS Start-End: 8-631
cggagccatgggcaagtgcagcgggcgctgcacgctggtcgccttctgctgcctgcagctggtggctgcgctggagcggcagatctttgacttcctgggctaccagtgggctcccatcctagccaacttcctgcacatcatggcagtcatcctgggcatctttggcaccgtgcagtaccgctcccggtacctcatcctgtatgcagcctggctggtgctctgggttggctggaatgcatttatcatctgcttctacttggaggttggacagctgtcccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgcgctcactgcagcctgtgcccaaccccgcgtctgcatctggagatgcggacttggacgtggacttggacttggacttggatttgagcttggctcttcgcagcccggacttcggaggagtggggcggggcgggggaggggcaccacgggttttttgttttttgtttgtttgtttttaatctcagccttggcgtgagctggggccttcctctcttctccagcctctccctttcactcttcacccagcatcctgcccccctgtccaaaaacagcaggacatcagacccatcccatcccaccacactcactcaccagctctggggaaagctactgtgaactaggagcaggattcctgggttctaatcgcaggtccatcactgactgtgacgtctagcaaagcccttgccctctctgagcctcggtttccgcacctcaagtaattaatcccttagcaaatggactcttttagacttctcatttaactcaattccctgagctagactgggattaaaattctcattttgcagtacattaaaactgaggcccagagatgtgatttgcttgaggccacacagctagatttttggtggaagtgggccttgaacacagtgtactttctgcagtttctgactgtaaaacccagtgtctgctctctgagttccatttccaagcccccctccatcttggacctatgtggtctccaccatattcacacaccaccaccaccacttgccaatgcctctcttaaagcaatatacccattcgttctcttattgggaactggatggatgaagccccaaattcagccccacccacagagaagccttcctacactcagcctctgtccacccttggcaaatctttcaagctctctcctccaggaaagtggggccccaactcagtcactccacccccttccaggtccctgaggctggttctactgtatccccatcacctccacaactccactcacccctgacggctccatccacctcaccagttggaaggcttgtggtttcagagaggagcaatgctggtcagcgctgcccagactccagtgtttacagatcaccagcatttacaaccaatccaatggccagaagcctcctctaacaagcccagaaggagttctgaaggggcagatgggggtgtgagtagtcggggagtcgggattgccagcaccctcacccttccttgggggcaagtagaggtgagaacactttccccacctccctccacagacactcctgaggacgctgcatcccacgcactgcctggtgcgtccatagagagaggatcaggtctcagcatttcatctgtgaaagaggcatggccctgggttagaaaggagggcaggagacatggaggaactggggggcacccagatggtgcagatggtttgcacacctgagcctgtctgtggtgaccattccgctcctctcccactaccctccaatctatcattccctactctctaaggccaaaatatcctgagcaaggctggcaaccccaccccaccatcccaaatgcaagcagccaggcccaggagttcctctggcccccacaggcatggagctcccagctggtgggtacagcttgagaggggggcagctccctcaggctaagctactgcccttcactgggccagccctgcctccagccctcacctctctcaccccaactctcccccaagcccctttctactcaacgggtgtagccactggtgctttgaagccttttgtttttataagatggtttttgcaaggggaccaggttctcttttcactgggaccttgcaaggaggggagtgctctcctggtttctgtgcaggcgggttgattaaagatggtgttttcttctcta

SEQ ID NO: 157227 - DNA, 569 bp, Homo sapiens
  Payload ID: 10817
  Gene Symbol: NKAIN1
  Gene Name: Na+/K+ transporting ATPase interacting 1
  ENST ID: ENST00000526106
  CDS Start-End: 1-455
tgggctaccagtgggctcccatcctagccaacttcctgcacatcatggcagtcatcctgggcatctttggcaccgtgcagtaccgctcccggtacctcatcctggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgttcctggaggaggaggacagctttgacttcatcggcggctttgactcctacggataccaggcgccccagaagacgtcgcatttacagctgcagcctctgtacacgtcggggtagcctctgccccgcgcccaccccggcgcctcgccctgggctgaccgcagctgccgcgagctcgggccaaggcgcaggcgtgtccccctggtggcccgcgcgctcactgcagcctgt

SEQ ID NO: 157228 - DNA, 562 bp, Homo sapiens
  Payload ID: 10817
  Gene Symbol: NKAIN1
  Gene Name: Na+/K+ transporting ATPase interacting 1
  ENST ID: ENST00000530145
  CDS Start-End: 184-562
ctctgcacagttcctgccttctaagtaacaaagacacagcaaggccggttatgatttacaatcaccacagccctcagattagtgtttcggagctgacgcaaccaggtggctgcgctggagcggcagatctttgacttcctgggctaccagtgggctcccatcctagccaacttcctgcacatcatggcagtcatcctgggcatctttggcaccgtgcagtaccgctcccggtacctcatcctgtatgcagcctggctggtgctctgggttggctggaatgcatttatcatctgcttctacttggaggttggacagctgtcccaggaccgggacttcatcatgaccttcaacacatccctgcaccgctcctggtggatggagaatgggccaggctgcctggtgacacctgttctgaactcccgcctggctctggaggaccaccatgtcatctctgtcactggctgcctgcttgactacccctacattgaagccctcagcagcgccctgcagatcttcctggcactgttcggcttcgtgttcgcctgctacgtgagcaaagtgt

SEQ ID NO: 157229 - DNA, 1106 bp, Homo sapiens
  Payload ID: 10818
  Gene Symbol: NKAIN2
  Gene Name: Na+/K+ transporting ATPase interacting 2
  Uniprot ID: Q5VXU1
  ENST ID: ENST00000368416
  CDS Start-End: 61-627
gtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcagtaagtgttggcagccaaccgctccttctagtgcctctggggttgttttatttctgtgcgaactcagtgcacacaaatggaatctgtgggtaaagtgtggcctttttgctttttcctcattaatgcgacttttaacaggaaatcctcaggttaaactaaaccatcctctggacttagtgtgctgattttcttcgacaattagtaaataccctttgttatcatcagcattttacataggaaatccaatcagtcaagatgtgattacgtgacttttggtagacttttccaaggattctgaagggatgatcagagatttttttcataacgttctacagtactcaaaattataagatttccataagtgttttctcttttagtgcttcttttggctgtgctgctagccctgggatttctctttttcatttgccctatctccttcttccttcctagatttctcccaggcaccatccatcacctttaatctcccactttttttccagaaaaaatcacattttctatagattctaattctaagacattcatgcccccatttttcatagtactgtaacaat

SEQ ID NO: 157230 - DNA, 3115 bp, Homo sapiens
  Payload ID: 10818
  Gene Symbol: NKAIN2
  Gene Name: Na+/K+ transporting ATPase interacting 2
  Uniprot ID: Q5VXU1
  ENST ID: ENST00000368417
  CDS Start-End: 61-687
gtgggggctcgacggtggccgacgtgggacagtctggctgtggcaggggtctcggaaaccatgggttattgcagtggcaggtgcacgcttatctttatctgtggcatgcaactggtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatacttaagtttctgagccatccct

SEQ ID NO: 157231 - DNA, 3052 bp, Homo sapiens
  Payload ID: 10818
  Gene Symbol: NKAIN2
  Gene Name: Na+/K+ transporting ATPase interacting 2
  Uniprot ID: Q5VXU1
  ENST ID: ENST00000545433
  CDS Start-End: 42-665
cttatttgtccctctggtatatttacaggtactgaagatggatggggatcattaggtttctcttattatattgtcccacaaatatcttaaccgtttgtgtgctggagaggcaaatatttgacttccttggatatcagtgggcacctatcctggcaaattttgtacatattattatcgtcattcttggtttgtttggaactattcaatatagacctcgttacataacaggatatgctgtctggctagtcctctgggttacgtggaatgtgtttgttatctgcttctatttggaggctggggacctctcaaaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcactggcaggtttcatctacgcctgttatgttgtgaaatgtataactgaagaagaggacagctttgatttcataggtggctttgactcttatggctatcaagggcctcagaagacatctcatttacaactacagcctatgtacatgtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcatttt

SEQ ID NO: 157232 - DNA, 148 bp, Homo sapiens
  Payload ID: 10818
  Gene Symbol: NKAIN2
  Gene Name: Na+/K+ transporting ATPase interacting 2
  ENST ID: ENST00000546092
  CDS Start-End: 2-148
ggtttgtgtgctggagaggcaaatatttgacttccttggatatcagtgggcacctatcctggcaaattttgtacatattattatcgtcattcttggtttgtttggaactattcaatatagacctcgttacataacaggataccatgtg

SEQ ID NO: 157233 - DNA, 1988 bp, Homo sapiens
  Payload ID: 10819
  Gene Symbol: NKAIN3
  Gene Name: Na+/K+ transporting ATPase interacting 3
  Uniprot ID: Q8N8D7
  ENST ID: ENST00000523211
  CDS Start-End: 133-726
agccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtgtatacagtgtggactgccctctgggtcacctggaatgtgttcattatctgcttttatttggaagtaggtggactctcaaaggacaccgatctaatgacattcaatatctctgtacatcggtcatggtggagagaacatgggcctggttgtgtcagaagagtgctgcctccctcagcccatggcatgatggacgattacacgtacgtctctgtcacaggctgcatcgttgacttccagtacctggaggtcatccacagtgctgtccaaatactactctctttggtgggttttgtgtatgcctgttatgtgatcagtatttccatggaagaagaagacacatattcatgtgatctgcaagtatgcaaacatctttttatccagatgctgcaaattattgaataagcaagaattagtaagatattatcaccaaattgtcacatcagtcaagcctcatgtgcttcctaagaactgaggtgatgcattattttagagtgtcattctaaaccccagattcaacatcttcctaatctttctagtgcagtctaatatataaattttatgaaaagcataggtttttttttaaccagcagtgctctttgagaatttacattgattcctaaagattgccattgctttgtataaaatgttataaattatcttagcatcttacctggaatttccactaaattcaccaatttatgatttgtgaaatctgattttactttttgaaaattttcatgtgaatttcccattttcagtgttgtagcacctctctcttcctctaagatcctgcaagctcatcaaaagccatgatcttattataccagcagttttatttattcaatctttcaacaagtagttattgaacttctataatgtgccaggctctggagctcgccttacaccaaacagacacaatcgatccattcgaagtgtcgtaattacacattgagggaccaactagaccttttctcattgtaaacttggagcaaaagtaaattcattaaaataaatttacattatagtgccacaaaaaaatgaacagaaccagaaagcattttttacaaaaattaacagaacagtgtgatagaggggaaaaggatgtgagatcatggtgccctaccttcaatagggtggccagaaaacacctctctgaagaagcagcatttgagctgagacctgaagaacgaggagtcagtgatgcagagaacctcaggagatgccttccaatctgagaaaagaggtgtacaagcaacatggtgccggcacctgctcagcttttggaaaggactcaggaagcttttactcatgatggaaggcaaagcgggaggaggcacatcacatagcaagagtggaagcaagagagacgtcatgctcttttaagcaatcagctctcaggtgaactaatagagtgagaactcactcatttctgtggggagggcatcaagctatttataatggatccatcctcatgacacaaacactgctatctcccacctctaacactggagatgacacttgaacatgagatttggaggggacaaatatcaaaactatatcatatggtttgcagatattttcttccatccttgagttatcttttcattttgttaattgtttcctttgctgtgctgaagctttgtttaatgaaatcccatttgtct

SEQ ID NO: 157234 - DNA, 414 bp, Homo sapiens
  Payload ID: 10819
  Gene Symbol: NKAIN3
  Gene Name: Na+/K+ transporting ATPase interacting 3
  ENST ID: ENST00000524201
  CDS Start-End: 112-414
ggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtctcagcattagagaggcagatctttgacttccttggtttccagtgggcgcctattcttggaaattttctacacataatagttgtcatattgggtttgtttgggaccattcagtacagacctcgatacataatggtggacaccgatctaatgacattcaatatctctgtacatcggtcatggtggagagaacatgggcctggttgtgtcagaagagtgctgcctccctcagcccatggcatgatggac

SEQ ID NO: 157235 - DNA, 793 bp, Homo sapiens
  Payload ID: 10820
  Gene Symbol: NKAIN4
  Gene Name: Na+/K+ transporting ATPase interacting 4
  ENST ID: ENST00000370307
  CDS Start-End: 246-686
tccaactcccaccccgggccccggaccgcagctggtcgtagtggccgcggaggacggcagcttttgggggccgggcgggagaagcgtccgttcatccgcggaaccaagctgaggtcgccgccctggagaggcaggtgtttgacttcctgggctaccagtgggcgcccatcctggccaactttgtccacatcatcatcgtcatcctgggactcttcggcaccatccagtaccggctgcgctatgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccc

SEQ ID NO: 157236 - DNA, 1421 bp, Homo sapiens
  Payload ID: 10820
  Gene Symbol: NKAIN4
  Gene Name: Na+/K+ transporting ATPase interacting 4
  ENST ID: ENST00000370313
  CDS Start-End: 353-712
tccgtggctgtgcagcttgggtgtcctgtgctcggcttaggggcacaggcttgcgggcggacctagggacggcggaggcatcgtgtccttcctgcaggaaggaaggagcttccggcgctttcctgggaggctcgctggggccgcggagataacctgaggtcctgcaacaggctgggggcccaaggaccatcccaggccttggaacagttggtatctttcagtcgccgccctggagaggcaggtgtttgacttcctgggctaccagtgggcgcccatcctggccaactttgtccacatcatcatcgtcatcctgggactcttcggcaccatccagtaccggctgcgctatgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctca

SEQ ID NO: 157237 - DNA, 1430 bp, Homo sapiens
  Payload ID: 10820
  Gene Symbol: NKAIN4
  Gene Name: Na+/K+ transporting ATPase interacting 4
  Uniprot ID: Q8IVV8
  ENST ID: ENST00000370316
  CDS Start-End: 91-717
gggtccaggctgcggcgcgtggggagcgggcggagcgggggcgggggccgagcgcggggcacccgggggcctcctgtataggcgggcaccatgggctcctgctccggccgctgcgcgctcgtcgtcctctgcgcttttcagctggtcgccgccctggagaggcaggtgtttgacttcctgggctaccagtgggcgcccatcctggccaactttgtccacatcatcatcgtcatcctgggactcttcggcaccatccagtaccggctgcgctatgtcatggtgtacacgctgtgggcagccgtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttgcctgcgtaagtgaggaaacagctgatcctgctcctgtggcctccagcctcagcgaccgaccagtgacaatgacaggagctcccaggccttgggacgcgcccccacccagcaccccccaggcggccggcagcacctgccctgggttctaagtactggacaccagccagggcggcagggcagtgccacggctggctgcagcgtcaagagagtttgtaatttcctttctcttaaaaaaaaaaaagaaaagaaaacatacaaaagaaaaggcaaaaccccacatgcccacctcctctggcaacatgggggtcacagctctgcccccaggctgtcgtctcgtcgaggagcccctccctcaggtgcccacctggggctgctggaccctcgggctgcaagcactgctgctgggatgcagcctccccaggaagtcaatgtgaggcccgagacccctcaagcggtgagggcccctgttgaacatggagggttcctaaccccaaactcgtgccagaagaacccccaccccacccaggagctgaggctgatggagccctagggtgggggctgggcttgaccaggaacagcagagccaggccccaaggcatagggcagggcacatggtggtgacgagcaggcagtactcttgtaaagggggctcttgggcaaacagtcccaaaggctcccccaggtatcatcaagttggtaaataaacaggaacatggccctca

SEQ ID NO: 157238 - DNA, 506 bp, Homo sapiens
  Payload ID: 10820
  Gene Symbol: NKAIN4
  Gene Name: Na+/K+ transporting ATPase interacting 4
  ENST ID: ENST00000370317
  CDS Start-End: 1-504
gtctgggtcacctggaacgtcttcatcatctgcttctacctggaagtcggtggcctcttaaaggacagcgagctactgaccttcagcctctcccggcatcgctcctggtggcgtgagcgctggccaggctgtctgcatgaggaggtgccagcagtgggcctcggggccccccatggccaggccctggtgtcaggtgctggctgtgccctggagcccagctatgtggaggccctacacagttgcctgcagatcctgatcgcgaatcccagatggcttgctccacagaggaggaggaacccctggtggctgctggctggagtgggctggggccaaagcttctgggctttgtctgtggctgccaggtggtcagcgtgtttacggaggaagaggacagctttgatttcattggtggatttgatccatttcctctctaccatgtcaatgaaaagccatccagtctcttgtccaagcaggtgtacttccccacaggccagaccccactgaga

SEQ ID NO: 157239 - DNA, 4780 bp, Homo sapiens
  Payload ID: 10821
  Gene Symbol: NACAD
  Gene Name: NAC alpha domain containing
  Uniprot ID: O15069
  ENST ID: ENST00000490531
  CDS Start-End: 21-4709
ggcgggcgcacggccaggccatgcctggggaggctgcccgcgccgagctgctgctgcccgaggcggaccgacccgggccccgcacagatctgtcctgcgatgcggccgctgccaccaccatcctgggaggggaccggcgggagccctgtgctctgaccccagggcccagccacctggccctcacgttcctgcccagcaagccgggtgcccggccccagcccgagggagccagctgggatgcagggcctggtggggcaccctcggcctgggcggacccaggggagggcggcccaagccccatgctcctccctgagggcctgtcttcccaggctctgtccacggaggctcctctcccggccaccctggagccccggattgtgatgggagaggagacgtgccaggccctcctgtcacccagagctgcccggacagcgctcagggaccaggagggtgggcacgcaagcccagacccaccccccgagctgtgttctcagggtgatctttctgtgccttcccctcccccagaccctgattccttcttcacgcctccctccacccccaccaagaccacctatgccctgcttcctgcctgtgggccccacggggacgccagggactcagaggctgagctgcgggatgagctgctggactcgccccccgcctcaccctcgggctcctacattacggccgatggggacagctgggcctcttcaccctcctgttccctcagcctgctggctccggctgaagggctggacttcccctcaggctggggcctgtccccgcaggggtccatggtggatgaacgagagctgcacccagcagggaccccagagcccccgtcctctgagtccagcctctctgcagacagcagctcctcctggggccaggagggccacttcttcgacctggacttcctggccaatgacccaatgatccccgcagccctcctacccttccagggcagcctcatctttcaggtggaggcagtggaggtgacaccgctatccccagaggaagaagaagaggaggctgtggcggatcccgacccaggtggggacctggctggggagggtgaggaggacagcacgtctgcctccttcctgcagtcactgtctgacctgtccatcacggagggcatggacgaggcttttgccttccgggacgacacctctgcagcctcctctgattcagactcagcctcctacgcagaggcagatgatgagaggctgtacagcggggagccccatgcccaggccactttgctccaggacagtgtccagaagacagaggaggagagcggaggtggggccaaggggctgcaggctcaggatgggactgtgtcctgggccgtggaggctgctcctcagacctcagacagaggggcctatctgtcccagagacaggaattgatctcagaagtaacagaagagggccttgctttaggccaggagtccactgccactgtgacccctcacactctgcaggtagccccaggcctccaggtggaggtggctaccagagtgaccccacaggctggggaggaagaaacagactccaccgctggacaagaatctgctgccatggcaatgcctcagccctcccaggagggcatcagcgagatcttaggccaagagtctgtcactgcagaaaaacttccaactccacaggaagaaacaagcctcacattgtgtccagactctcctcagaacttgaaggaagaaggagggctggacctcccctctggcagaaagcctgtagctgcagccacgattgtccccaggcaggctaaagaggacctcaccttaccccaggactccgctatgacaccgcctctgcccctacaagacacagatctctcatcagccccaaagcctgtggctgcagccacgattgtgtcccagcaggctgaagagggcctcaccttaccccaggactccgttatgacaccgcctctgcccctacaagacacagaactctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgcttgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgattgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacaccgcctctgcccctacaagacacagatctctcgtcagccccaaagcctgtggctgcagccacgcctgtgtcccagcaggctgaagagggcctcaccttaccccaggactccgctatgacagcacctctgcctctgcaagacacaggccccacctcaggtccagagcctctggctgtggccacccctcaaaccttgcaggcagaagcaggctgtgccccagggacagagcctgtggccaccatggctcagcaggaagtaggtgaggccttaggccccaggccagcacctgaggagaagaatgcagccctccctacagtcccggagcctgcagccttggaccaggtccaacaggatgacccacagccagctgcagaagctgggacaccttgggccgcacaggaagatgcggattccactttgggcatggaggccctcagtctccctgagccggcctctggtgctggggaggaaatagcagaagccctttctaggcctggacgggaagcatgtctggaagcgcgagcgcacacaggtgatggggctaagcctgactcaccccaaaaggagaccctggaggttgagaaccagcaggaaggaggcctgaagccactggcacaggaacatggacccaggtcagcacttggaggtgcaagggaggtccccgatgcgcctcctgctgcctgccctgaggtcagccaggcccggctcctgagcccagccagggaggaaagaggcctgagtggcaagtccaccccggagcccacgcttccctcagctgtggccacagaggccagtctggactcctgcccagagtcttcagtaggggctgtgtccagtctggacagaggctgccctgacgcgcctgcccccacgtctgcaccaacctcccagcagccggagcctgtactgggtctgggcagtgttgagcaaccccacgaagtacccagtgtccttggcacccccttgctgcagcccccagaaaaccttgccaagggtcagcccagcacgcccgtggacaggcccctgggccctgacccttctgctcctggtacccttgctggggcagccctacccccactggagcccccagccccctgcctgtgccaggacccccaggaagactctgtggaagacgaggagcccccaggctctctgggcctcccaccgccccaggcaggagtccagcctgccgctgctgctgtctcaggaaccacacagcctctggggactgggccgcgagtcagcctctcgcctcactccccactcctcagccccaaggtggcctccatggatgccaaagacctggccttgcagatcttgccgccttgccaagtgcctcctccctctgggccccagagcccagctggccctcaagggctctcagcccccgagcagcaagaggatgaggacagcctggaggaagactcgcctcgggccctgggctcgggccagcattcggatagccacggggagtcatcagccgagctggacgagcaggacatcttggctcctcagaccgtgcagtgtccagcccaggccccagcaggcggcagtgaggagaccatcgccaaagccaagcagagtcgcagtgagaagaaggcccgaaaggcaatgtcaaagctgggcttgcggcagattcagggagtcaccaggatcaccatccagaagtccaagaacatcctctttgtcatcgccaagcctgatgtcttcaagagcccagcctcagacacttatgtggtctttggcgaggccaagattgaggacctgtcccagcaagtgcacaaagccgcagctgagaagtttaaggtgccctcagagccctcagccttggtccctgagtcagcacccaggccccgggtgaggctggagtgcaaggaagaggaagaggaggaggaggaagaggtggacgaggcggggctggaactgcgtgacattgagctggtgatggcgcaggccaatgtgtccagggccaaggccgtgcgggctctgagagacaaccacagtgacatcgtcaacgccatcatggaactgaccatgtagccactgaccggaagctggagccatcctacgccttccctcagctctgctactcaataaatcggtgtcccttc

SEQ ID NO: 157240 - DNA, 6899 bp, Homo sapiens
  Payload ID: 10822
  Gene Symbol: NACC2
  Gene Name: NACC family member 2, BEN and BTB (POZ) domain containing
  Uniprot ID: Q96BF6
  ENST ID: ENST00000277554
  CDS Start-End: 157-1920
aaagtccatgggagccggagcgccgggacgccaagcacttcctgccgcgggcggcgcgccgcagctgcccaggccggaccgggccgggcgcccgcagatgagccccgctagggccgccccgcgctgagagcccagccccgccgctgcccgcccgccatgtctcagatgctgcacatcgagatccccaacttcgggaacacagtgctgggctgcctgaacgagcagcgcctgctgggcctctactgcgatgtgtccatcgtggtcaagggccaggccttcaaggcccaccgggcggtgctggccgccagcagcctctacttccgcgacctgttcagcggcaacagcaagagcgccttcgagctgcccggctccgtgccgcccgcctgcttccagcagatcctgtccttctgctacacgggcaggctcaccatgacggccagcgagcagctcgtggtcatgtacacggccggcttcctgcagatccagcacatcgtggagcgcggcaccgacctcatgttcaaggtgagctcgccccactgcgactcgcagaccgctgtgatcgaggacgccggctccgagccccagagcccctgcaaccagctgcagccggccgccgccgccgcggccccctacgtcgtgtccccctcggtgcccatcccgctgctgacccgagtaaagcatgaagccatggagctgccgccggccggcccaggcctggcccccaagcgcccgctggagacggggccccgggacggcgtggcggtggccgcgggggctgcggtggcggcgggcacagcccctctcaaactgccccgtgtctcctactacggggtgcccagcctggccaccctcatccccggcatccagcagatgccctacccccagggggagcggaccagtccaggcgccagcagcctgcccaccaccgacagccccacctcgtaccacaacgaggaggacgaggaggacgacgaggcctacgacaccatggtggaggagcagtacggccagatgtacatcaaggcctccggcagctatgcagtgcaagagaagcctgagccagtgccgctggagagccgctcctgcgtcctcatccgccgcgacctcgtggccctacctgccagcctcatcagccagatcggataccgctgccatcccaagctctactcggaaggggaccccggggagaagctggagctggtggcaggctctggggtctacatcacacgcggccagctgatgaactgccacctgtgtgcaggggtgaagcataaggtcttgctgcggaggctcctggccaccttctttgacaggaacacgctggccaacagctgcgggactggcatccgctcgtccaccagcgaccccagccggaagccgctggacagccgggtcctgaacgctgtgaaattgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccggcggccgcggcccggaggccggagggcacctatgcagggaccttgtaagcggagctgggtggctgcgcgagggaccgagtactagagctgcttgcatgcgttactaatacaaacaaatgtgatcaagccacttacctactgaactgctactgttgcctgagaaaaatgtgatttttattctgcttgtatttaaaattgatgaaggaaacaaatgcattcattatactgtaaacaattaggccactggcagcctcctgcgaggaagttcccagggctcccttttgatattcacaaggtcagcctccaagtgtagcttccctcccccttcttggggagggtgggaggccgccaggcccctggtgcccagccctgccccttcctccctgcccttcctgctcctcctgcccggaagacgaagcaggggccggcggtggtctgtggcgagggggctgggctgtgcgtcactgacccttccttccttccccatggaacctctctggggcgacggggcagggctcaggctccagggcctaactcctcgtttttccttctttcggagactcggggccaggcccaccgggccttccacctgtgtggggtgtgtgcacgagtgtgtgtgtgtgcgtgtgtgtgcaggggtgtggtgagggggcagtgatggctgtggcccacccctcggggtggagaaaagggtactttactctgcccccacaccctgtccttgttctgcccgatccgtctcggctctgcagcccctcggtcccctgacccccagggcaccgctgaccccgcctggcctcccactgtcccgcccgggcccactgtgggacgtgcacagctgatgtagcacacgctgccctctgccgcctcagccactttgggattatgcttgtcttgttttttttaggttttgttgtaatttagatctatttcatatatggtttggaaactttcagactcaatagaacaaaaactttgggtgggatgggtgtccctgtccccagcccaccatggcttggggtgggtcatctgtggccgttagggtgcgtccccctgctcccccgcccagggccagggaccactcgtctcccactgggggaaaaagggggtcccgggtgggcgactagtacgtgtgaagctgagctcagggccggacctggggagcgggggactccgctcgggcaggaggcagcggccagggctgggccagggcgagagtcggtcctcccggtgctgggctccccgtctgccttgaggggtgtgcatggatggagggtgcctgaggctgcaggcaggggatgaccgggacaggcctgggctggggcagttggaggtatgggcactggtaggggacagagggttagggatcatgttggggggccagggacagtggaggaagggcccatggaagatggggctgtttggtttgaggctggagtgcttcctttgaaatttaattactgttttttaagtggtagggctcacagactgtgtgaagtcctgtgtgaagtgctggtgtggccacctacccaggtgtccctcccttttgttttggaggcctgtgtccttgtccaggggcagccctccttcccaggtgtggccagaagaaccccccatcccaagacttgaaatgtctgttgctcacctctgtccctccagaactcggcttccccatcttcacttgcaaaacaagtgcagccctgcgcccatcagcaccccctccggtgtgcacacaggccagtgagcggtggccgaccagcgcaccccactcccccaacctccacaacccatcaagcggaggccgcctccgctaggggaggaccatgtgctgcaccctggcctggggacctacagggtgtgggttagacgcattcccactgggcggctcctttctgccccgaagcccacccctgtggcgaggccctaggagacctcccgtggggccgcctctacagacagcactcagcctcctgggctgcctccagccaggcccagcacatgcctgccctccagaaaaatacgttgctttccagaaggaggtgggggaccatgggcaggcactgtggacgctaacctcggcccctccacccattcctcagggcccacgtccagggggaccaagacctgcattcctagggctgcaggtggctcagtggtgcagaggcatccagaccttctgctgaactaagaaccacccagcctagagggagcctttctctgcctcttcctcccctgtcttgggcacaggtggggttggagcccccatggggcccgctgggaacctggaccaagccttcctcggagatgggaggaagccgcggggtggagcaggggcaggtaggtgaggttgagctgcacttgagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgcacagaggacgcctgactgctgttcaggcccgcacaatgtcccgtgccccttcctcactcgtttgtaatcgccgtctgttttgttctgggtaaggaaggcaagagctatagataaaacttaaataataataatttaatgtgaatgggttctgagctctccctgcgccccgggcgggccaggccgagcattttgcactaatgtgtcccacggtgggcgtgagtcgggagtgtctgtggacgtgcgtggctgctgagcggacctgctgtgtgctccctccacgtcctgaatgtaccgtggggcgggggcggcggcccgggctcagaggggccttccagagtgccttagcatcctttgatcatttttcccaaggaaaccaattaagaaagccggacccttccctcctttgtttacaagatgactaattctagaatccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttatggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacttttgtcatgtcagccagccagctccgtgggtgagagtgtgcgtgtgcgcgtgtctgtgtgtgtgtgcgtgtctgtgtgtgcacgtctgtgcgtctgtgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaagatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaa

SEQ ID NO: 157241 - DNA, 6802 bp, Homo sapiens
  Payload ID: 10822
  Gene Symbol: NACC2
  Gene Name: NACC family member 2, BEN and BTB (POZ) domain containing
  Uniprot ID: Q96BF6
  ENST ID: ENST00000371753
  CDS Start-End: 60-1823
atgagccccgctagggccgccccgcgctgagagcccagccccgccgctgcccgcccgccatgtctcagatgctgcacatcgagatccccaacttcgggaacacagtgctgggctgcctgaacgagcagcgcctgctgggcctctactgcgatgtgtccatcgtggtcaagggccaggccttcaaggcccaccgggcggtgctggccgccagcagcctctacttccgcgacctgttcagcggcaacagcaagagcgccttcgagctgcccggctccgtgccgcccgcctgcttccagcagatcctgtccttctgctacacgggcaggctcaccatgacggccagcgagcagctcgtggtcatgtacacggccggcttcctgcagatccagcacatcgtggagcgcggcaccgacctcatgttcaaggtgagctcgccccactgcgactcgcagaccgctgtgatcgaggacgccggctccgagccccagagcccctgcaaccagctgcagccggccgccgccgccgcggccccctacgtcgtgtccccctcggtgcccatcccgctgctgacccgagtaaagcatgaagccatggagctgccgccggccggcccaggcctggcccccaagcgcccgctggagacggggccccgggacggcgtggcggtggccgcgggggctgcggtggcggcgggcacagcccctctcaaactgccccgtgtctcctactacggggtgcccagcctggccaccctcatccccggcatccagcagatgccctacccccagggggagcggaccagtccaggcgccagcagcctgcccaccaccgacagccccacctcgtaccacaacgaggaggacgaggaggacgacgaggcctacgacaccatggtggaggagcagtacggccagatgtacatcaaggcctccggcagctatgcagtgcaagagaagcctgagccagtgccgctggagagccgctcctgcgtcctcatccgccgcgacctcgtggccctacctgccagcctcatcagccagatcggataccgctgccatcccaagctctactcggaaggggaccccggggagaagctggagctggtggcaggctctggggtctacatcacacgcggccagctgatgaactgccacctgtgtgcaggggtgaagcataaggtcttgctgcggaggctcctggccaccttctttgacaggaacacgctggccaacagctgcgggactggcatccgctcgtccaccagcgaccccagccggaagccgctggacagccgggtcctgaacgctgtgaaattgtactgtcagaacttcgcccccagcttcaaggagagcgagatgaacgtgatcgccgcggacatgtgcaccaacgcccgccgcgttcgcaagcgctggctgcccaagatcaagtccatgctgccggagggcgtggagatgtaccgcacggtcatgggctccgccgccgccagcgtgcccctcgaccccgagttcccgcctgccgcggcacaggtgttcgagcaacgcatctacgccgagcggcggggcgacgccgccaccatcgtggctctgagaactgacgccgtgaatgttgacctgagtgccgccgccaaccccgccttcgacgccggcgaggaggtggacggggctggctcggtcatccaggaggtggccgcccccgagccgctgcccgccgatggccagagccccccacagccctttgagcagggcgggggcggccccagcaggccccagacgccggcggccgcggcccggaggccggagggcacctatgcagggaccttgtaagcggagctgggtggctgcgcgagggaccgagtactagagctgcttgcatgcgttactaatacaaacaaatgtgatcaagccacttacctactgaactgctactgttgcctgagaaaaatgtgatttttattctgcttgtatttaaaattgatgaaggaaacaaatgcattcattatactgtaaacaattaggccactggcagcctcctgcgaggaagttcccagggctcccttttgatattcacaaggtcagcctccaagtgtagcttccctcccccttcttggggagggtgggaggccgccaggcccctggtgcccagccctgccccttcctccctgcccttcctgctcctcctgcccggaagacgaagcaggggccggcggtggtctgtggcgagggggctgggctgtgcgtcactgacccttccttccttccccatggaacctctctggggcgacggggcagggctcaggctccagggcctaactcctcgtttttccttctttcggagactcggggccaggcccaccgggccttccacctgtgtggggtgtgtgcacgagtgtgtgtgtgtgcgtgtgtgtgcaggggtgtggtgagggggcagtgatggctgtggcccacccctcggggtggagaaaagggtactttactctgcccccacaccctgtccttgttctgcccgatccgtctcggctctgcagcccctcggtcccctgacccccagggcaccgctgaccccgcctggcctcccactgtcccgcccgggcccactgtgggacgtgcacagctgatgtagcacacgctgccctctgccgcctcagccactttgggattatgcttgtcttgttttttttaggttttgttgtaatttagatctatttcatatatggtttggaaactttcagactcaatagaacaaaaactttgggtgggatgggtgtccctgtccccagcccaccatggcttggggtgggtcatctgtggccgttagggtgcgtccccctgctcccccgcccagggccagggaccactcgtctcccactgggggaaaaagggggtcccgggtgggcgactagtacgtgtgaagctgagctcagggccggacctggggagcgggggactccgctcgggcaggaggcagcggccagggctgggccagggcgagagtcggtcctcccggtgctgggctccccgtctgccttgaggggtgtgcatggatggagggtgcctgaggctgcaggcaggggatgaccgggacaggcctgggctggggcagttggaggtatgggcactggtaggggacagagggttagggatcatgttggggggccagggacagtggaggaagggcccatggaagatggggctgtttggtttgaggctggagtgcttcctttgaaatttaattactgttttttaagtggtagggctcacagactgtgtgaagtcctgtgtgaagtgctggtgtggccacctacccaggtgtccctcccttttgttttggaggcctgtgtccttgtccaggggcagccctccttcccaggtgtggccagaagaaccccccatcccaagacttgaaatgtctgttgctcacctctgtccctccagaactcggcttccccatcttcacttgcaaaacaagtgcagccctgcgcccatcagcaccccctccggtgtgcacacaggccagtgagcggtggccgaccagcgcaccccactcccccaacctccacaacccatcaagcggaggccgcctccgctaggggaggaccatgtgctgcaccctggcctggggacctacagggtgtgggttagacgcattcccactgggcggctcctttctgccccgaagcccacccctgtggcgaggccctaggagacctcccgtggggccgcctctacagacagcactcagcctcctgggctgcctccagccaggcccagcacatgcctgccctccagaaaaatacgttgctttccagaaggaggtgggggaccatgggcaggcactgtggacgctaacctcggcccctccacccattcctcagggcccacgtccagggggaccaagacctgcattcctagggctgcaggtggctcagtggtgcagaggcatccagaccttctgctgaactaagaaccacccagcctagagggagcctttctctgcctcttcctcccctgtcttgggcacaggtggggttggagcccccatggggcccgctgggaacctggaccaagccttcctcggagatgggaggaagccgcggggtggagcaggggcaggtaggtgaggttgagctgcacttgagttccctctggagtttccttcatctgccccacacccaaatttgcactttaatttgaccatccctgggggcctggctgctgacagaagggctctctctgccctccactccaaagtgggtgcccccccacccttggccaggacagggagggagccgctggctgctgccggaggtggtggctgcacagaggacgcctgactgctgttcaggcccgcacaatgtcccgtgccccttcctcactcgtttgtaatcgccgtctgttttgttctgggtaaggaaggcaagagctatagataaaacttaaataataataatttaatgtgaatgggttctgagctctccctgcgccccgggcgggccaggccgagcattttgcactaatgtgtcccacggtgggcgtgagtcgggagtgtctgtggacgtgcgtggctgctgagcggacctgctgtgtgctccctccacgtcctgaatgtaccgtggggcgggggcggcggcccgggctcagaggggccttccagagtgccttagcatcctttgatcatttttcccaaggaaaccaattaagaaagccggacccttccctcctttgtttacaagatgactaattctagaatccggggttgtcctgtcctgtgagtgtgaccctgactcatccagaccctgtagagagagacgagccactcagtatttatgagatgtctgcacctttatccctaagcctgactattagcaatacgcatatcctatatagaatctattacagagctacgttatctccacaccttttgaggaggacagaagggactggaccgtgttggagctgccgcctggcaggtggtgggcctgggatctagccgcctctcctgccctgccttcctcttccccaaggggatgggcccaggaggcagctgggttgcatggagaggtccaggagggaccggaggtgtgacagatactgtgagcccggcgggccgcgcctggctgggtgcctcggtacttgaattctgtcttgttttccgcattgtgtctgtccacccgagttctctgtcgtcacttaactttgcattggatttggttgttgtactttgcccctgaatgtggacaaagctgtgggcaagaggtcagcaggacccgcctgggggtgccggcgttggtgactgcgggtcggggctcctagaacataggagccggctgcctggcctcctttctcctccaggaagagtcattctttggcatttgtgtttagagccaggaggaaggcggaaggtagggagggagggctggtccccctctgagggggctctagtgcctgaccctgacctgtcctcattcgacagctgaaactgttaagcgctggcccagtccccccaccccacccagccgtgtactgcctgggctcccctcaaagggaaatttttatggaaacatcttggcagcaagtggaaaaagatctatggcccatgaaccaactgaaaactccaagaaccctctgtctgcctctgccagcagcgagtcctaagcgcagaatccagagctcgtagctgtcctcagctgtaactactgtttcagaatgttgctgctgcatacttttgtcatgtcagccagccagctccgtgggtgagagtgtgcgtgtgcgcgtgtctgtgtgtgtgtgcgtgtctgtgtgtgcacgtctgtgcgtctgtgtgtgcgcgtctgtgcatgtgtgtgtctgtgcgtgtgtgcgtctgtgtgtgtgcgtctgtgtgcgcgtgtgtgtgcgcgtctgtgtgtatgtgtgcacgcgcgtctgtgtgcacgtgcgtgtctctgcacgcgtgtctgtgtatgtgtgcacgcgtgtgtctgtgtgtgtgcacgcgcgtgcacgtcaccaccggagcatttagggtttggtacaagatggttctaaaatggcaaaggtttttcgtgtttgtttgttttgtttctttggaaaaagaaaaggaaaggaaaatcatgcagaatcgcaagcattcagactggacgaccggctcgtattccgatcagtcgcttccattgttagcatcgtacacgattgtgatttttatgtcaaaagaagccaaaacttgcaatactatttttagcagacaaaaaaaagaactaagtataaaatgtataaatatttttgacttgaagatttggatggcactgggtgcaagtagagcatccatccttcggatggaatgtttggaaaaaagagacttttaaaaaggagacggttgttttaaagagtctgtttaggggttaaagtactgtaactcacgactgttaaaaaataaattttcctgtgctgtaaaggaaggtttcacagtaccactgagttagatttcagccacagatgcttagctttttttttttgtcttttttttaaggaggaagcctttgttttgttttcctgagccctcactctgtttttgtgctgttactcggtagagtcaagactgttactttttagccatggctgacattgtatcaataactaaaactgaaacattcaaaagcgaacagggaaaccgagggcttcaagcgtgctcagagccgtttcagacagtggaaatccatgacaaacaaaaggatgtgatcattaattgtaaagcgctttgtaaaattcacatttacaaaataataaagtcagttcaaacctaa

SEQ ID NO: 157242 - DNA, 3035 bp, Homo sapiens
  Payload ID: 10823
  Gene Symbol: NAALAD2
  Gene Name: N-acetylated alpha-linked acidic dipeptidase 2
  ENST ID: ENST00000321955
  CDS Start-End: 48-2171
aagctcgcgaatgtagcaggcgccccaagctcggtcctcaagaagccatggcggaatccaggggccgtctgtacctttggatgtgcttggctgctgcgctggcatctttcctgatgggatttatggtgggctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagaatacactttcagacttgatgttgaagaaggagtgggaatcccccgaatacctgtacatcccattggatataatgatgcagaaatattattacggaaggttagaatgcatgtttataacatcaataaaattacaaggatttacaatgtagttggaactatcagaggatctgtggaacctgacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggagaatgtcaaaatactccaggagagaagcattgcttatatcaactcggattcatctatagaaggcaattatactctcagagttgactgtactccccttctttaccaattagtgtataaactgacaaaagagatccccagccctgatgatgggtttgagagtaaatcactgtatgaaagctggttggaaaaagacccttcacctgaaaataaaaatttgcctagaatcaataagctgggatctggaagtgactttgaagcttattttcagagacttggaattgcttcaggcagagcccgttacactaagaataagaaaacagataagtacagcagctacccagtgtaccacacaatttatgagacatttgaattggtagagaaattttatgaccccacatttaaaaaacaactttctgtggctcaattacgaggagcactggtatatgagcttgtggattctaaaatcattccttttaatattcaagactatgcagaagctttgaaaaactatgcagcaagtatctataatctatctaagaaacatgatcaacaattgacagaccatggagtatcatttgactccttattttctgctgtgaaaaacttctcagaggctgcttcagattttcataaacgacttatacaagttgatcttaacaatcccattgcagtgagaatgatgaatgaccaactgatgctcctggaaagagcattcatcgatcctcttggtttaccaggaaagctgttctataggcacatcatatttgctccaagtagccacaacaaatatgctggagaatcatttcctggaatctatgatgctatctttgatattgaaaataaagccaactctcgtttggcctggaaagaagtaaagaaacatatttctattgcagcttttacaattcaagcagcagcaggaactctgaaagaagtattatagaaggtctcaagtggctagccattaaaggtgttgctaaaagtctgaggataaaattcacctttctgataacttatgaagccagggtgttctaaactcttttcatgtcatgttttgattataggctttggtcttttcatctgcaaagccttttttttttgctctttaaaagttaataattatattagcaaagtgttaatctaatgaagtaaaaaactcctgtgtggcagaaagtaaaagaaaattccctaaattatagcaaggaacatgaattctcagacattgtgagtgtgggaatgtaaaatggtaaaatcacttttgaaaacagtttggcagtttcctataaagttaaacatacacttttactttaggactccagaattccacttctagttatttattcaagagaaggaaaaacaatgatcacagcaatacttgtatgcatgttcattgcaacttaaaagcgtaaaaaccccaaatgtccatccacagacgaatgtataaactgtggtatccattacacaatagactacttactactcagcaataaaaatgaagtaactttcaataaatgcaatattattggcagacattgttgaaggaaaaaagccagacaaacaactacataaaatatgtttctatttagatgaagtggcaaactaatctgtagtgttaaaaattagattagtgattgcctgggccaagtggcaggttggggaggatggctgcaaagaagtatgaggaaactttctccaatagatgagaattttccgtatcttgatctgagtggcaaattgtaaacttaaaatatatataaaatttattgtatgaaaattaagcctcaataaacgtgattataaaaaacaa

SEQ ID NO: 157243 - DNA, 1149 bp, Homo sapiens
  Payload ID: 10823
  Gene Symbol: NAALAD2
  Gene Name: N-acetylated alpha-linked acidic dipeptidase 2
  Uniprot ID: Q9Y3Q0
  ENST ID: ENST00000375944
  CDS Start-End: 22-939
aagctcggtcctcaagaagccatggcggaatccaggggccgtctgtacctttggatgtgcttggctgctgcgctggcatctttcctgatgggatttatggtgggctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaaggcacatcatatttgctccaagtagccacaacaaatatgctggagaatcatttcctggaatctatgatgctatctttgatattgaaaataaagccaactctcgtttggcctggaaagaagtaaagaaacatatttctattgcagcttttacaattcaagcagcagcaggaactctgaaagaagtattatagaaggtctcaagtggctagccattaaaggtgttgctaaaagtctgaggataaaattcacctttctgataacttatgaagccagggtgttctaaactcttttcatgtcatgttttgattataggctttggtcttttcatctgca

SEQ ID NO: 157244 - DNA, 730 bp, Homo sapiens
  Payload ID: 10823
  Gene Symbol: NAALAD2
  Gene Name: N-acetylated alpha-linked acidic dipeptidase 2
  ENST ID: ENST00000525497
  CDS Start-End: 466-730
aaaacctgaaattttgtggcacagcacctggtgagactgtgggtttgacaaatatctcaccactttatcatcaagttaaacattattcttttttattaaagcttaataattaaagcttaattctgcaagtgaaatttatatatactgctttattagtacatatatgacactttgttttcaaacattgccataacctgtttgaaggaacttgagcttcagggttacaaaactgcttctgctatgatggagaagaggaggaaaaaatgcttagataagagcaatttaacttaaatggaggaagtgtgtctatattgacaaaagtccaaagacttgttgagccagctaactgggctttttacaatggcttttcaagattgcagatgccgcctacagagacgacagtcatatttgagccccgaagctcgcgaatgtagcaggcgccccaagctcggtcctcaagaagccatggcggaatccaggggccgtctgtacctttggatgtgcttggctgctgcgctggcatctttcctgatgggatttatggtgggctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaaccc

SEQ ID NO: 157245 - DNA, 3600 bp, Homo sapiens
  Payload ID: 10823
  Gene Symbol: NAALAD2
  Gene Name: N-acetylated alpha-linked acidic dipeptidase 2
  Uniprot ID: Q9Y3Q0
  ENST ID: ENST00000534061
  CDS Start-End: 231-2453
agttgcccgccaacaggaagaatgtctcctccctctgcagggcttcctttcccccatcgagggcccctggggaccacaggtccccagcgggtagggcggaggcgtggccttgcgaaggtcagcggaggccacccagagctcacagcctcctgccagcgcgctctctgtttctctgcagccccgaagctcgcgaatgtagcaggcgccccaagctcggtcctcaagaagccatggcggaatccaggggccgtctgtacctttggatgtgcttggctgctgcgctggcatctttcctgatgggatttatggtgggctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagaatacactttcagacttgatgttgaagaaggagtgggaatcccccgaatacctgtacatcccattggatataatgatgcagaaatattattacgctacttgggaggaattgctccaccagataagagttggaagggagcccttaatgtgagttatagtatcggacctggctttacagggagtgattctttcaggaaggttagaatgcatgtttataacatcaataaaattacaaggatttacaatgtagttggaactatcagaggatctgtggaacctgacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggagaatgtcaaaatactccaggagagaagcattgcttatatcaactcggattcatctatagaaggcaattatactctcagagttgactgtactccccttctttaccaattagtgtataaactgacaaaagagatccccagccctgatgatgggtttgagagtaaatcactgtatgaaagctggttggaaaaagacccttcacctgaaaataaaaatttgcctagaatcaataagctgggatctggaagtgactttgaagcttattttcagagacttggaattgcttcaggcagagcccgttacactaagaataagaaaacagataagtacagcagctacccagtgtaccacacaatttatgagacatttgaattggtagagaaattttatgaccccacatttaaaaaacaactttctgtggctcaattacgaggagcactggtatatgagcttgtggattctaaaatcattccttttaatattcaagactatgcagaagctttgaaaaactatgcagcaagtatctataatctatctaagaaacatgatcaacaattgacagaccatggagtatcatttgactccttattttctgctgtgaaaaacttctcagaggctgcttcagattttcataaacgacttatacaagttgatcttaacaatcccattgcagtgagaatgatgaatgaccaactgatgctcctggaaagagcattcatcgatcctcttggtttaccaggaaagctgttctataggcacatcatatttgctccaagtagccacaacaaatatgctggagaatcatttcctggaatctatgatgctatctttgatattgaaaataaagccaactctcgtttggcctggaaagaagtaaagaaacatatttctattgcagcttttacaattcaagcagcagcaggaactctgaaagaagtattatagaaggtctcaagtggctagccattaaaggtgttgctaaaagtctgaggataaaattcacctttctgataacttatgaagccagggtgttctaaactcttttcatgtcatgttttgattataggctttggtcttttcatctgcaaagccttttttttttgctctttaaaagttaataattatattagcaaagtgttaatctaatgaagtaaaaaactcctgtgtggcagaaagtaaaagaaaattccctaaattatagcaaggaacatgaattctcagacattgtgagtgtgggaatgtaaaatggtaaaatcacttttgaaaacagtttggcagtttcctataaagttaaacatacacttttactttaggactccagaattccacttctagttatttattcaagagaaggaaaaacaatgatcacagcaatacttgtatgcatgttcattgcaacttaaaagcgtaaaaaccccaaatgtccatccacagacgaatgtataaactgtggtatccattacacaatagactacttactactcagcaataaaaatgaagtaactttcaataaatgcaatattattggcagacattgttgaaggaaaaaagccagacaaacaactacataaaatatgtttctatttagatgaagtggcaaactaatctgtagtgttaaaaattagattagtgattgcctgggccaagtggcaggttggggaggatggctgcaaagaagtatgaggaaactttctccaatagatgagaattttccgtatcttgatctgagtggcaaattgtaaacttaaaatatatataaaatttattgtatgaaaattaagcctcaataaacgtgattataaaaaacaagtctgcaaggaaaccagaatcatataccttctcttgtgaaatcaccatgaagtgtgaatggtcaggaaaaagccagtaatattcatacatttaataatttcagctctactgaataaacatataagtctgatgggtgatgaaaatagctactacaatcttcatattctaactcctataaagactgtatatcagaatctgcaaacttttatgcagatcccagtgactcaattacatgttcaactatgattaaagcttcaataaacttggttgttcatctacttca

SEQ ID NO: 157246 - DNA, 2061 bp, Homo sapiens
  Payload ID: 10823
  Gene Symbol: NAALAD2
  Gene Name: N-acetylated alpha-linked acidic dipeptidase 2
  ENST ID: ENST00000527493
  CDS Start-End: 145-996
gcgggtagggcggaggcgtggccttgcgaaggtcagcggaggccacccagagctcacagcctcctgccagcgcgctctctgtttctctgcagccccgaagctcgcgaatgtagcaggcgccccaagctcggtcctcaagaagccatggcggaatccaggggccgtctgtacctttggatgtgcttggctgctgcgctggcatctttcctgatgggatttatggtgggctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagctacttgggaggaattgctccaccagataagagttggaagggagcccttaatgtgagttatagtatcggacctggctttacagggagtgattctttcaggaaggttagaatgcatgtttataacatcaataaaattacaaggatttacaatgtagttggaactatcagaggatctgtggaacctgacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggtaaataagacaaagaaggttcttattatttttttggtcaacagggaacaaatatgtatgtgtctcaggatgatcaaaaatatattccattacctaatatggttttgttttggagaatgactcaagacaatttaagaaatagtttatttttactttcacatcagtttggcaataaccttttagtactagactgcagacagagttattgcctcttgtcaaaatattttcgttgccatttgcatttgttttataaaaaataagaaaaatcagtaagctcagaaaataatcaaaattaatgagatatttttgatgataatttacttatctaaaaactgatacagatgcttagagctaattttcaagtttttgaagtttctttagagttcttccatctgagaaaatataagatgttctattaagatggccatatattgactatattttcacattgacagattccatttaaaatggcaaccataagtatactttagcatttacaacagatatgtgcttcattgttaagtataaagtgataattctgtgaattgaattactttaataaattgacctgctttacaatttcataggtggggttttttttcttcacatatgattgtcatttgtcactgactcttaattatttatatttaagtgtctctcctagggcccttttcttccaacttcttcctttagtctctctgtcaagtaatctctaagttcttaaatgtagaag

SEQ ID NO: 157247 - DNA, 1613 bp, Homo sapiens
  Payload ID: 10823
  Gene Symbol: NAALAD2
  Gene Name: N-acetylated alpha-linked acidic dipeptidase 2
  ENST ID: ENST00000525171
  CDS Start-End: 31-1149
aggcgccccaagctcggtcctcaagaagccatggcggaatccaggggccgtctgtacctttggatgtgcttggctgctgcgctggcatctttcctgatgggatttatggtgggctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagagggagatcttgtatatgtgaactatgctcgcactgaagactttttcaaactagaaagagagatgggcatcaactgtactgggaagattgttattgcaagatatggaaaaatcttcagaggaaataaagttaaaaatgccatgttagcaggagccataggaatcatcttgtactcagatccagctgactactttgctcctgaggtacagccatatcccaaaggatggaatcttcctggaactgcagcccagagaggaaatgtgttaaatttgaatggtgctggtgacccactcactccaggctatccagcaaaagacaggtatgttattctgggaggtcaccgggactcctgggtatttggagctattgacccaaccagtggggttgctgttttgcaagaaattgcccggagttttggaaaactgatgagtaaaggctggagacctagaagaactatcatttttgccagctgggatgcagaagaatttggacttctgggttccacagaatgggctgaggtaaataagacaaagaaggttcttattatttttttggtcaacagggaacaaatatgtatgtgtctcaggatgatcaaaaatatattccattacctaatatggttttgttttggagaatgactcaagacaatttaagaaatagtttatttttactttcacatcagtttggcaataaccttttagtactagactgcagacagagttattgcctcttgtcaaaatattttcgttgccatttgcatttgttttataaaaaataagaaaaatcagtaagctcagaaaataatcaaaattaatgagatatttttgatgataatttacttatctaaaaactgatacagatgcttagagctaattttcaagtttttgaagtttctttagagttcttccatctgagaaaatataagatgttctattaagatggccatatattgactatattttcacattgacagattccatttaaaatggcaaccataagtatactttagcatttacaacagatatgtgcttcattgttaagtataaagtgataattctgtgaattgaattactttaataaattgacctgctttacaatttca

SEQ ID NO: 157248 - DNA, 484 bp, Homo sapiens
  Payload ID: 10823
  Gene Symbol: NAALAD2
  Gene Name: N-acetylated alpha-linked acidic dipeptidase 2
  ENST ID: ENST00000526637
  CDS Start-End: 164-484
ttcactgagttcactaaagacaacctacagctgtcactgtctgcagggatgaaaaaaaatcgttttatttccaagcaacattagctggtttattaagcctctcaaagaaacgaccacttctgtgcgctatcatcaaagtatacggtggaaactggtatccgaaatgaaagctgaaaacatcaaatcatttcttcgttcttttacaaagcttcctcatctggcaggaacagaacaaaatttcttgcttgccaagaaaatccaaacccagtggaagaaatttggactagattcagccaagttggttcattatgatgtcctcttatcttaccccaatgagacaaatgccaactatatatcgattgtggatgaacatgaaactgagattttcaaaacatcataccttgaaccaccaccagatggctatgagaatgttacaaatattgtgccaccatataatgctttctcagcccaaggcatgccagag

SEQ ID NO: 157249 - DNA, 2271 bp, Homo sapiens
  Payload ID: 10824
  Gene Symbol: NAALADL1
  Gene Name: N-acetylated alpha-linked acidic dipeptidase-like 1
  ENST ID: ENST00000339885
  CDS Start-End: 17-2236
gccaagagtccgcaggatgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagcttgggttctctgggtgctggcagcgactatgcacccttcgttcacttcctgggcatctcctccatggacattgcctatacctatgaccggagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcgggctccgtagtcacattccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactcc

SEQ ID NO: 157250 - DNA, 2376 bp, Homo sapiens
  Payload ID: 10824
  Gene Symbol: NAALADL1
  Gene Name: N-acetylated alpha-linked acidic dipeptidase-like 1
  Uniprot ID: Q9UQQ1
  ENST ID: ENST00000340252
  CDS Start-End: 1-2376
atgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctggtgagccctcctcttgctgcctgcaccccaggcccctgctctgctctggatgccgctgtcctcatccagccctgcccttgccaccacccagcccagctccccctgcccacctctccctctcctctggttctctgccccttttcctctggccagatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagcttgggttctctgggtgctggcagcgactatgcacccttcgttcacttcctgggcatctcctccatggacattgcctatacctatgaccggagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctga

SEQ ID NO: 157251 - DNA, 2100 bp, Homo sapiens
  Payload ID: 10824
  Gene Symbol: NAALADL1
  Gene Name: N-acetylated alpha-linked acidic dipeptidase-like 1
  Uniprot ID: Q9UQQ1
  ENST ID: ENST00000355721
  CDS Start-End: 1-2100
atgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagcttgggttctctgggtgctggcagcgactatgcacccttcgttcacttcctgggcatctcctccatggacattgcctatacctatgaccggagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctga

SEQ ID NO: 157252 - DNA, 2118 bp, Homo sapiens
  Payload ID: 10824
  Gene Symbol: NAALADL1
  Gene Name: N-acetylated alpha-linked acidic dipeptidase-like 1
  ENST ID: ENST00000356632
  CDS Start-End: 1-2118
atgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagcttgggttctctgggtgctggcagcgactatgcacccttcgttcacttcctgggcatctcctccatggacattgcctatacctatgaccggagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctga

SEQ ID NO: 157253 - DNA, 2699 bp, Homo sapiens
  Payload ID: 10824
  Gene Symbol: NAALADL1
  Gene Name: N-acetylated alpha-linked acidic dipeptidase-like 1
  Uniprot ID: Q9UQQ1
  ENST ID: ENST00000358658
  CDS Start-End: 29-2251
ctaccccagctggccaagagtccgcaggatgcagtggacgaaggtgttggggctggggctgggggctgctgccctcttggggctggggatcatcctcggccactttgccatccccaaaaaagccaactcactggccccccaggacctggacctggagatcctggagaccgtcatggggcagctggatgcccacaggatccgggagaacctcagagaactctccagggagccacacctggcctccagccctcgggatgaggacctggtgcagctgctgctgcagcgctggaaggacccagagtcaggcctggactcggccgaggcctccacgtacgaagtgctgctgtccttccctagccaggagcagcccaacgtcgtggacatcgtgggccccactgggggcatcatccactcctgccaccggactgaggagaacgtgaccggggagcaaggggggccagatgtggtacaaccctatgctgcctatgctccttctggaaccccacagggcctcctcgtctatgccaaccggggcgcggaagaagactttaaggagctacagactcagggcatcaaacttgaaggcaccattgccctgactcgatatgggggtgtagggcgtggggccaaggctgtgaacgctgccaagcacggggtagctggggtgctggtgtacacagaccctgccgacatcaacgatgggctgagctcacccgacgaaacctttcccaactcctggtacctgcccccctcaggagtggagcgaggctcctactacgagtattttggggaccctctgactccctaccttccagccgtcccctcttccttccgcgtggaccttgccaatgtctccggatttcccccaattcctacacagcccattggcttccaggatgcaagagacctgctctgtaacctcaacggaactttggccccagccacctggcagggagcactgggctgccactacaggttgggtcccggcttccggcctgacggagacttcccagcagacagccaggtgaatgtgagcgtctacaaccgcctggagctgaggaactcttccaacgtcctgggcatcatccgtggggctgtggagcctgatcgctacgtgctgtatgggaaccaccgagacagctgggtgcacggggctgtggaccccagcagtggcaccgccgtcctcctggagctctcccgtgtcctggggaccctgctgaagaagggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagcttgggttctctgggtgctggcagcgactatgcacccttcgttcacttcctgggcatctcctccatggacattgcctatacctatgaccggagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaa

SEQ ID NO: 157254 - DNA, 942 bp, Homo sapiens
  Payload ID: 10824
  Gene Symbol: NAALADL1
  Gene Name: N-acetylated alpha-linked acidic dipeptidase-like 1
  ENST ID: ENST00000530995
  CDS Start-End: 759-942
ctcccctcctcacgtcagcagcctttctcctaaggcaccctaggatcaggaggaccctgtcctccaaccctctatcccccattcccaggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccagagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctg

SEQ ID NO: 157255 - DNA, 973 bp, Homo sapiens
  Payload ID: 10824
  Gene Symbol: NAALADL1
  Gene Name: N-acetylated alpha-linked acidic dipeptidase-like 1
  ENST ID: ENST00000528884
  CDS Start-End: 593-673
agcagcctttctcctaaggcaccctaggatcaggaggaccctgtcctccaaccctctatcccccattcccaggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgatccgctcaccaggccctggcgacctgagcatctacgacaactggatccggtacttcaaccgcagcagcccggtgtacggcctggtccccaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacaggtgagtctgtcccagagtcctgggaggtgcctccaggtggggccggacaatggctccccacctgagacgaggtggtcagcttctctgccctttagagtgcaacccagcccctgaagaagatgggaatgtaaggctcagggaggggaggaaagttgcttgagggtccctctgggagctaggactggaacccacatttcctcccccgaccgccactgctgtaagagctccctggccttcagagacaagtggacgggggtgcttttctgcctcgctgcgtacaggagctgagccagttctaggccca

SEQ ID NO: 157256 - DNA, 959 bp, Homo sapiens
  Payload ID: 10824
  Gene Symbol: NAALADL1
  Gene Name: N-acetylated alpha-linked acidic dipeptidase-like 1
  ENST ID: ENST00000526799
  CDS Start-End: 651-914
taggatcaggaggaccctgtcctccaaccctctatcccccattcccaggcacctggcgtcctcgcagatcaatcgtgtttgcgagctggggggctgaggagtttgggctcattggctccacggaattcacagaagagttcttcaacaagctgcaggagcgcacggtggcctacatcaacgtggacatctcggtgtttgatccgctcaccaggccctggcgacctgagcatctacgacaactggatccggtacttcaaccgcagcagcccggtgtacggcctggtccccagagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcggcagccaccctgaggcctgtggctgacctctgaccccagccctctttcttcagccctccctttactccaaccctctcc

SEQ ID NO: 157257 - DNA, 800 bp, Homo sapiens
  Payload ID: 10824
  Gene Symbol: NAALADL1
  Gene Name: N-acetylated alpha-linked acidic dipeptidase-like 1
  ENST ID: ENST00000526516
  CDS Start-End: 570-800
gccgcgtgcggcggacggggccgctacgggtgggcggggctggggagtggtactctctagatctgctggggctggactgaggctggggcaagcctcgtaaggactggaccacgggtgggcaggagaccggtggagaacccgccctgttgttggggctggggagggccgcgcaccgagactaaattctccttccggccagatccgctcaccaggccctggcgacctgagcatctacgacaactggatccggtacttcaaccgcagcagcccggtgtacggcctggtccccaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctggagggtgcg

SEQ ID NO: 157258 - DNA, 851 bp, Homo sapiens
  Payload ID: 10824
  Gene Symbol: NAALADL1
  Gene Name: N-acetylated alpha-linked acidic dipeptidase-like 1
  ENST ID: ENST00000533340
  CDS Start-End: 771-851
ttttcccgctctcccctcctcacgtcagcagcctttctcctaaggcaccctaggatcaggaggaccctgtcctccaaccctctatcccccattcccaggcacctggcgtcctcgcagatcaatcgtgtttgcgagctggggggctgaggagtttgggctcattggctccacggaattcacagaagtgagtggccctacagggtaggggatcgaaaggggttcccaggacagaacggcgcggggctgacgtcgcccctcgcacccgcaggagttcttcaacaagctgcaggagcgcacggtggcctacatcaacgtggacatctcggtgtttgccaacgctacccttagggtgcaggggacgccccctgtccagagcgtcgtcttctctgcaaccaaagagatccgctcaccaggccctggcgacctgagcatctacgacaactggatccggtacttcaaccgcagcagcccggtgtacggcctggtccccaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccat

SEQ ID NO: 157259 - DNA, 690 bp, Homo sapiens
  Payload ID: 10824
  Gene Symbol: NAALADL1
  Gene Name: N-acetylated alpha-linked acidic dipeptidase-like 1
  ENST ID: ENST00000533753
  CDS Start-End: 1-297
gagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccctccctttactccaaccctctcctgcctgctttcctgagatgtcctggtcttccttggtgccagaagagggcactaccacaggaccctctcaagcttctcaggcaacagcttgaggtccctgaggggagtggcaagccctaatgcaactcaccctcatcctggtgcttaggtggcagagggtgggcagcaggggacagggatgggatggcaaaaccaccaactgcccttggtggcaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaacaaaa

SEQ ID NO: 157260 - DNA, 563 bp, Homo sapiens
  Payload ID: 10824
  Gene Symbol: NAALADL1
  Gene Name: N-acetylated alpha-linked acidic dipeptidase-like 1
  ENST ID: ENST00000530139
  CDS Start-End: 352-563
cgtgcggcggacggggccgctacgggtgggcggggctggggagtggtactctctagatctgctggggctggactgaggctggggcaagcctcgtaaggactggaccacgggtgggcaggagaccggtggagaacccgccctgttgttggggctggggagggccgcgcaccgagactaaattctccttccggccagatccgctcaccaggccctggcgacctgagcatctacgacaactggatccggtacttcaaccgcagcagcccggtgtacggcctggtccccagcttgggttctctgggtgctggcagcgactatgcacccttcgttcacttcctgggcatctcctccatggacattgcctatacctatgaccggagcaagacttcagccaggatctaccccacctaccacacagcctttgacacctttgactatgtggacaagtttttggacccgggcttcagcagccatcaggctgtggcccggacagcggggagtgtgattctccggctcagtgacagcttcttcctgcccctcaaagtcagtgactacagtgagac

SEQ ID NO: 157261 - DNA, 566 bp, Homo sapiens
  Payload ID: 10824
  Gene Symbol: NAALADL1
  Gene Name: N-acetylated alpha-linked acidic dipeptidase-like 1
  ENST ID: ENST00000532802
  CDS Start-End: 345-566
actctctagatctgctggggctggactgaggctggggcaagcctcgtaaggactggaccacgggtgggcaggagaccggtggagaacccgccctgttgttggggctggggagggccgcgcaccgagactaaattctccttccggccagatccgctcaccaggccctggcgacctgagcatctacgacaactggatccggtacttcaaccgcagcagcccggtgtacggcctggtccccagggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggctccgtagtcacattcccgggcctatccaatgcctgctccagggccagggacacagcttctggatctgaagcttgggctgaggtccagagacagctcagcattgtggtgacagccctg

SEQ ID NO: 157262 - DNA, 495 bp, Homo sapiens
  Payload ID: 10824
  Gene Symbol: NAALADL1
  Gene Name: N-acetylated alpha-linked acidic dipeptidase-like 1
  ENST ID: ENST00000533842
  CDS Start-End: 391-495
ctgaggctggggcaagcctcatccgctcaccaggccctggcgacctgagcatctacgacaactggatccggtacttcaaccgcagcagcccggtgtacggcctggtccccaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacagccatgtgctctgggcacctcgcacgggc

SEQ ID NO: 157263 - DNA, 635 bp, Homo sapiens
  Payload ID: 10824
  Gene Symbol: NAALADL1
  Gene Name: N-acetylated alpha-linked acidic dipeptidase-like 1
  ENST ID: ENST00000532450
  CDS Start-End: 1-147
tcaccaggccctggcgacctgagcatctacgacaactggatccggtacttcaaccgcagcagcccggtgtacggcctggtccccaggcttcagcagccatcaggctgtggcccggacagcggggagtgtgattctccggctcagtgacagcttcttcctgcccctcaaagtcagtgactacagtgagacactccgcagcttcctgcaggcagcccagcaagatcttggggccctgctggagcagcacagcatcagcctggggcctctggtgactgcagtggagaagtttgaggcagaagctgcagccttgggccaacgcatatcaacactgcagaagggcagccctgaccccctgcaggtccggatgctcaatgaccagttgatgctcttggaacggacctttctgaaccctagagccttcccagaggaacgctactacaggtgggtggagatgggatgcgtgccaacctcagatgccaactcaggtcatcaaggccaaggaccagtggcgaaagtgagtcttggggtaccttaggccttggctagtctgcgttcctctccctgcatgctgtgtatcctaactccctacaacagcccctcaaataaatcacatctagtgactggtaccaacaaaa

SEQ ID NO: 157264 - DNA, 936 bp, Homo sapiens
  Payload ID: 10825
  Gene Symbol: NAALADL2
  Gene Name: N-acetylated alpha-linked acidic dipeptidase-like 2
  ENST ID: ENST00000414826
  CDS Start-End: 1-165
gctgaagtcatcgatgtgagttatggaatggcagatgatttaaaaaggattaggaaaataaaaaacgtaacaaatcagatcgcactcctgaaattaggaaaattgccactgctttataagatgaaagttttagacaaagccgatcaaacctcacctctctattagtgcagcccatctctgcacccctcgttgcaaaactgatctcttcgccaaaagctagaaccaaaaatgaagcgtgtagctctctagagcttccaaataatgattatactacagagagttgaattattcttgtaggataaatttctaagtacaggattgcttttgttattgctatgaagagtaatattgccttaccaacggattgttcaaattagcaatgccaacagcagcagaaataagagtcgtcagcatgcaagttcagacagtcacaaaattgaaaacagttactaatgttgttggatttgtaatgggcttgacatctccagaccggtatatcatagttggcagccatcatcacactgcacacagttataatggacaagaatgggccagtagtactgcaataatcacagcgtttatccgtgccttgatgtcaaaagttaagagagggtggagaccagaccgaactattgttttctgttcttggggaggaacagcttttggcaatattggctcatatgaatggggagaggatttcaagaaggttcttcagaaaaatgttgtggcttatattagcctccacagtcccataagggggaactctagtctgtatcctgtagcatcaccatctcttcagcaactggtagtagaggaaccttagttccaggtttgatgattagtcctcagtatatccacagagctcttatatgaagagaattcttcctcttctaacacacataataacctatgaagatattaaatattttgcccctt

SEQ ID NO: 157265 - DNA, 9865 bp, Homo sapiens
  Payload ID: 10825
  Gene Symbol: NAALADL2
  Gene Name: N-acetylated alpha-linked acidic dipeptidase-like 2
  Uniprot ID: Q58DX5
  ENST ID: ENST00000454872
  CDS Start-End: 129-2516
ttattcacagaagaaagcaggtagtatactgttacaatactacagtagaaagtcagaaggtcacaaagcttgcagggtaagtgacacaacttgaaactgcttggccctctttaaaaagaaataataaaatgggagagaatgaagcaagtttacctaacacgtctttgcaaggtaaaaagatggcctatcagaaggtccatgcagatcaaagagctccaggacactcacagtacttagacaatgatgaccttcaagccactgcccttgacttagagtgggacatggagaaggaactagaggagtctggttttgaccaattccagctagacggtgctgagaatcagaacctagggcattcagagactatagacctcaatcttgattccattcaaccagcaacttcacccaaaggaaggttccagagacttcaagaagaatctgactacattacccattatacacgatctgcaccaaagagcaatcgctgcaacttttgccacgtcttaaaaatactttgcacagccaccattttatttatttttgggattttgataggttattatgtacatacaaattgcccttcagatgctccatcttcaggaacagttgatcctcagttatatcaagagattctcaagacaatccaggcagaagatattaagaagtctttcagaaatttggtacaactatataaaaatgaagatgacatggaaatttcaaagaagattaagactcagtggacctctttgggcctagaagatgtacagtttgtaaattactctgtgctgcttgatctgccaggcccttctcccagcactgtgactctgagcagcagtggtcaatgctttcatcctaatggccagccttgcagtgaagaagccagaaaagatagcagccaagacctgctctattcatatgcagcctattctgccaaaggaactctcaaggctgaagtcatcgatgtgagttatggaatggcagatgatttaaaaaggattaggaaaataaaaaacgtaacaaatcagatcgcactcctgaaattaggaaaattgccactgctttataagctttcctcattggaaaaggctggatttggaggtgttcttctgtatatcgatccttgtgatttgccaaagactgtgaatcctagccatgataccttcatggtgtcactgaatccaggaggagacccttctacgcctggttacccaagtgtcgatgaaagttttagacaaagccgatcaaacctcacctctctattagtgcagcccatctctgcacccctcgttgcaaaactgatctcttcgccaaaagctagaaccaaaaatgaagcgtgtagctctctagagcttccaaataatgaaataagagtcgtcagcatgcaagttcagacagtcacaaaattgaaaacagttactaatgttgttggatttgtaatgggcttgacatctccagaccggtatatcatagttggcagccatcatcacactgcacacagttataatggacaagaatgggccagtagtactgcaataatcacagcgtttatccgtgccttgatgtcaaaagttaagagagggtggagaccagaccgaactattgttttctgttcttggggaggaacagcttttggcaatattggctcatatgaatggggagaggatttcaagaaggttcttcagaaaaatgttgtggcttatattagcctccacagtcccataagggggaactctagtctgtatcctgtagcatcaccatctcttcagcaactggtagtagagaaaaataatttcaactgtaccagaagagcccagtgcccagaaaccaatatcagttctatacagatacaaggtgatgctgattatttcatcaaccatcttggagttcccatcgtgcagtttgcttacgaggacatcaaaacattagagggtccaagttttctctccgaggcccgtttttctacacgagcaacaaaaattgaagaaatggatccctctttcaaccttcatgaaaccattactaagctctcaggagaagtgattttgcaaattgccaacgaacctgttctgccctttaatgcacttgatatagctttagaagttcaaaacaaccttaaaggtgatcaacccaacactcatcaactgttagccatggcgttacgcctgcgggagagtgctgaactttttcagtctgatgagatgcgacctgctaatgatcccaaggagagagcacccatccgcatccggatgctgaatgacattctccaagacatggagaaaagctttctggtaaagcaggcaccaccaggtttttatagaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattgagaaaactctgagcatttttaaaagtttgtttacaattccacaagcaaaagctctaatttaaccagattttctgacattgaaggcttattttccccaatggctttttgacaagtataaagctattattacattgtattttttaaatgtaaatatagaaagaacattttgcacatttaatatttttcttatatctacatttctgaatatgtaaagcaagttattgaaataggacttaagaattacctattaaaaagaaatctgatatataaaaatatgtactattttaaggaaaaatttccaagaagttctggactatctttgttcctatggggagggcatataggaacacagtttattctctctgatagagctattaatgacttagtttctgtaaaagaaatggagagttgatatggttcagattaacttcactattaagtgttcaatatgaagaattcaagtattctgactgagtgattggttgacctaaaccactttgaatgtttctattttatgaaatgaagtttctcttcttaacacaactagatgtagtaatacactggttatgaaattgtatttttttaagtattaatgaaaaaagagccataagcattccaggagaaaatctcaagggagctacatagagcaatttaaatgcaaatttttttcctaacaacttacaaggtgactagctttgaaacccctaatttgcctcagttgattttctaagaatttcaggagtgatgtatgtcttaagagggagaaaaaaatatttcttattactttttctcttgtttctgttggaaacactgaagcagggactctaaaatgaaagcatctcacattggttttctttcttgtatcttttctgaaactccttgctgtaaggcagctttctcagagtactatatattttcaacagtaaagtagcagagtttctctttgaaacccaaaatgtcttctaaagaatcaaatttctatttctgcctctgacaaaaagaacttactatgaaagaaatagttgttttatcaataaaagccccttaatattatgaagaaacttttcatattttttcttctttatccttaattgtgactaagatggaaatctagaaaatattcatgcttctaagtttctgcagtgttactgtaagagagtgtctcgtctacacttcagttcttctctcatgtggaaaactaagctttttatattgacattgccattgaatagctctagcaactattattattcccccaaaccctaaaattctacctattaggtgtcaggttaaagttctaatttatctttagaaatttatgtgaaaaatggttttcctatactggataaagcaattccccttaggaaacatagcctcagagtatttcatataaattttctctatctaattcaaacatatctccccatgatacaccgccagagtgacattgcagacagtctgtgtatgtttaaattttcactttttatggatgagcataaacctagtcttagtttaaaggcaaactaaagttgaggggaaataattaatcaatactgattaattgatttataaggttcaacactgtctaccctaaataatttttatatgctcaaggcaaagcagggaatagaggcaattagctagataattcaagcagaaatccattttcatcgaaattgcctgtgtgcacatatttttagatgaaaaatgaaactaccttacaatattatttttttaaccaatgtatttgtttgcaaacatttgccatgttgaagagtgtgtataggaaaggtctagaaataaataggcttgtgcatacctaggcattcatgctctttcttcctcttcagagatcatcagaaaagaggtgggaatacacaagcaggtgcatgtaagcccaaaagctagaaagccttatatttaaccaaaggttgatgtgttcattccagttattcacttacagatgaaactaaaacaaataaaggcaagctattatcagtttggtagttcattattttagaacaaatttctaaattaatttattcccataacctacaatagcactgagaacagaaaacatgtttcttcttcattttgtttaaagattgcgtacctaggtaagtcacactgtatagataaaaaccttcttctgtattcctcacctctaaattatatgttatttgctatttgaaaactgtagttaactatggttttttattagtctattaaaagatacgtggagatattaaattatacctaaagcagacgtccaacaaattctgtacatgctgctttacatctttgcaacaaacctcttaactagcagcattatttctatagtgtgattacctgagggtgcctccaaatgtatatcatttcactcccctcccctccccacccccaatagattcaaataaataaaatcctgagcaaattaatagcaagtgttaatgtgaattggtagtaggtttaagctgttgctgagtcgtctatatgcctggtacttctcacaatctttcatacatagaattgtgcctaggaaataatgaatcataaatattctctgaagaaaatgtggtaaaggtgtaacggtgaaatttatgttcaggcagggtacacatgagatactgccctttatggaaaagcataagtctcagaatcaaaagaaagcctaataaagattctggtctaagccctgagatcttgccttcagccagagaaggcattatcaattacccccaccagatatagtaactaaacccaaagtgagtaagaaacttggacatagtcatgtatttagttagtaacaaaagcaccactggaatttaagcttctctgctttctcatgcagtatatcttgcttctccctgaggagacagggttataaatgatcttttccagtgcattcgatgtaaccagccattctgtcagatgttgcatgggctggaaacactgcttttaattcaaggctagttcattctctgactgtacctgacaaacaaaactctccccgagaattcaggcaaaggacacaaagactgggtacttgagagaaagtggggagaatccttacagaacaccagaagtcaggaagaaggacattgagcaaaatatatctgtaagagggcaagtcaggccagtgttaagtcaacaatctaaatcaccgtttctcaaaatgtgaaatttagaaagacagggctaggaatctacatcttcagcaagatttctggatgtctgttacacacactgaagtttaagaatttccaatctacgttaatcgtagtttccaagaaaacactaattgacatttctaaataaattgaagagtcataataacaagaaagacgtaaagatttgttattaatggaatcattatgagaaaagaaaagtggacccattttatctctaagaaaacaattcagttgcagcttatatttgtgcctgctacatcccaggcactggtgttttagaatttttcccatgtatccttttttttttttttttttttttttaattcccacaacaacccatttcaaaatgagaaaactaggttgagtgacttgtccacagttccaaagctaataaaaatgatgaggcatatttctcttctgggcccactgtattcagttctttgttctttacactgagtgccgaaaaaaaaaatcagactattttgattctagaaagtgagataattgaaaatgttaacatatttctccaaaactgatcagactgtggagtctgtcacttttttggtataataaaggagtttgaagaaacaaatgacatcattcctgatgatggtagcccactccaacaaaggcgtatatatgtaggcaagtttgaagatatctataagagcattaaaaggcaagtgcaccattgtggaatatcatgacgagtaggcttacaaacagtaaaaagagaccagaaaccacaagtcttacactttcattctctaaatgcttatataatttcactaaaaaaagaaaagcaggtgctgtgatttagaacaacagttttatgttatttttaaaaattcagaataaccaattgactttttaaattaaataaacgtagagcatatagtaagtttccccacaggaaagacagatgttaacaaaaataaaataaatgattatttgtgaccatgttactaatgatgaatcagcatctttgcctcaaatgaaaatctataattatttgtatgataaattggtagacctagccaaaaatgttctcatgagacattctgtgatatgtgtaattgattactccaaaaattaagctttctctgagggtaacacattgtcatctcattggtttaatgggctatttaaatgtgccttagccacacatttgcttaatagaaaggaattattttaaactaccaatccatatgttgagtggaaaggaagttggcccacatattccaataaatatatcagcaatataacagtttcatcatgggaccatggatacagtgcagggaaaaaacaaacaaacaatatttgagaaaatatatatattctgcccagccacactggtgagtttttatttcttgtatgagtttaaattgccaacttaaaaaagcctcattagaatttgctattcgaaaagaccttaaaaaccctcacagagttctaaacatcccattcattgaaaataattttcagttaagtagatttgttttgtgcacttcacaacttttaggtgacatgaatttgaagcgtagcaaaagaaatgtataaagatagccttttctggtcattaccatgtctactcaagtttctgttttctaggtacactctagcattgtaactttttccccctgagaagtaattttaagatctatcagtctcaatttaaatgatctgttaatcagccagagttttagtttcataatatcgttccattgcctgacaaagatatacacactgaagtgcctttagcagacctgggaccgtcaagaatcttgttaccctgattattgcaagatgacatatttcttaagccatttataatctcatattcgggttgaatctgaatttacaaataaaagggttaaattgaggcagtttcaagcagcatttaggaaaatgaagtggcttcaaattttagtgtttctggttacattattttgtttgaattatacaattacataattttctgtaaccaaaatggtaattttgatggattttttaaatgccaaaatccaatcatcaaggccaaagaaatgcatgattactctgatttcttatgcaccattcagtcaagacttaactcagaggcagttgattcagtgcttacatctagacaaagctttaatgagtgcagacccagcctaacagtatttcatctaatttctttgatggcttaagccaataagcactgaggtagcttttctcagaaggaaacagattttattttccaggggctaattaatatgcaccacctaagtccccaaaggatcacacaggtgcctgtatcatgccatatgtcatgtgctatattcctgcaagctcaagagattaatatacaatcattattatgaattattatgttgcattgaagttaatgtcggtcttttgttctaattaaagtacaaacgtggcatctgaatagaagcttagctagagaagtggagttagagtccctattttaatgaactacatatatttttcaatcaaaatgtgtaattatttaattatctagcctgctcagtaatcataactctccaacttcttcaaagggcctttattcaatatgttaccactcatatggtcattacttggtaagtgttttatattttgaatttcttagatgctttcagtgtatgtgctagtgttttattaatattaaaaatttttgtttacttatatatcaagctgctgcaaatggactaccttattttaaaagttagaataaaatgctattactctctaaacagaactttagcatatctgtttgataagaaatacacaaacaaaatatttttctatgctattgcaaattgtccgcaggaagcaaaatgccagatggttaagtgtagctcacataattatattccaaaggtgttataaacaattctatttagcatctgagataggtctatattaggcaatttcatgtttacatttctaacagaaaggtttaatggcaaatattccttatattctaacttgctacttggagaatatggatattctgaaaagaaaaaccctttctagaacactgtgcaggactaatttttttttaatagacatccagaaaatagcctgggcaacaaagtgagaccctgtctctcttaaaaaaaaaaaaaaaaaaaaaaaaaaaagaaaagaaaaagtagctaggcatgttggtgtgcacctttgtagtccagctactagggaggctgaggcggaagaatcatttgggcccaaaagtttgaagctgcagtgagctaaaatcatgccactgtagtccagcctgtgtaacagaacctatctcaaaaaaaggaaaagaaagtcacatgctgttgatagtagttttatatgtatttggaatgttaatatgggacacatgcatttaatactttaatcatgtattcaatgtagcagcatttagatatgtaagattttagaagtaaaatctcagtggtataacatttaaaacacagccttaaaatgaagaatagggatgagcaggagaaaatttataaattaacccagggtaaaatttggaggaaaatttttccaaataaatttgctttgattaaaaacacatatctctcaagaggtgtcccaattactaaattatgttgaactgttgtggtgtttagccttgttcaaaatgatttgattatcatctggattcagaaatcttttcattgtacagagatttcattgtcattgtcgttgttgttaactgatttttaatgatattgatttagaggcatttgtcggtagtttttaaattactatatagggttgaatgtctaatttctataatgtgtggatgcccatcagatatttagtgcattctatatttagcccaagtgtgatcacaatttattttataactttttatgtgttacttacatgactcaatatgcatcttacttaagaaattatgttgtgatctggagtgacacaaatggattgagataccacatccattaaaaatataagtgaatattttatatttaagttgtttaaatatttgcacattattgaaaacatagtactaggaaatgaaggcaccatttaacaaacgtgttctgaatcataattttcatgagtttgtacgtgaaatgttaatgtttaaaacacccattttgaaattattaaatacaggtaaaaacattgc

SEQ ID NO: 157266 - DNA, 574 bp, Homo sapiens
  Payload ID: 10825
  Gene Symbol: NAALADL2
  Gene Name: N-acetylated alpha-linked acidic dipeptidase-like 2
  ENST ID: ENST00000434257
  CDS Start-End: 230-574
ggcccggcagccgtaccgcagacgagcccgcgcccgcgccgctcaggaggctgagggaagaaaagaataatttaaatgaaatttagtttctataaagaaaacgattaaaaacaaggaaatgagcattgactattaggcacctggatgaagactgggtccagattgtcagtctcctgtaacctgcagaagccctccagttgcactaggaacattcaattgaagtaaaaagatggcctatcagaaggtccatgcagatcaaagagctccaggacactcacagtacttagacaatgatgaccttcaagccactgcccttgacttagagtgggacatggagaaggaactagaggagtctggttttgaccaattccagctagacggtgctgagaatcagaacctagggcattcagagactatagacctcaatcttgattccattcaaccagcaacttcacccaaaggaaggttccagagacttcaagaagaatctgactacattacccattatacacgatctgcaccaaagagcaatcgctgcaacttttgccacgtcttaaaaatactttgcacagcc

SEQ ID NO: 157267 - DNA, 4789 bp, Homo sapiens
  Payload ID: 10825
  Gene Symbol: NAALADL2
  Gene Name: N-acetylated alpha-linked acidic dipeptidase-like 2
  ENST ID: ENST00000614002
  CDS Start-End: 1-2352
ttcacaggtaaaaagatggcctatcagaaggtccatgcagatcaaagagctccaggacactcacagtacttagacaatgatgaccttcaagccactgcccttgacttagagtgggacatggagaaggaactagaggagtctggttttgaccaattccagctagacggtgctgagaatcagaacctagggcattcagagactatagacctcaatcttgattccattcaaccagcaacttcacccaaaggaaggttccagagacttcaagaagaatctgactacattacccattatacacgatctgcaccaaagagcaatcgctgcaacttttgccacgtcttaaaaatactttgcacagccaccattttatttatttttgggattttgataggttattatgtacatacaaattgcccttcagatgctccatcttcaggaacagttgatcctcagttatatcaagagattctcaagacaatccaggcagaagatattaagaagtctttcagaaatttggtacaactatataaaaatgaagatgacatggaaatttcaaagaagattaagactcagtggacctctttgggcctagaagatgtacagtttgtaaattactctgtgctgcttgatctgccaggcccttctcccagcactgtgactctgagcagcagtggtcaatgctttcatcctaatggccagccttgcagtgaagaagccagaaaagatagcagccaagacctgctctattcatatgcagcctattctgccaaaggaactctcaaggctgaagtcatcgatgtgagttatggaatggcagatgatttaaaaaggattaggaaaataaaaaacgtaacaaatcagatcgcactcctgaaattaggaaaattgccactgctttataagctttcctcattggaaaaggctggatttggaggtgttcttctgtatatcgatccttgtgatttgccaaagactgtgaatcctagccatgataccttcatggtgtcactgaatccaggaggagacccttctacgcctggttacccaagtgtcgatgaaagttttagacaaagccgatcaaacctcacctctctattagtgcagcccatctctgcacccctcgttgcaaaactgatctcttcgccaaaagctagaaccaaaaatgaagcgtgtagctctctagagcttccaaataatgaaataagagtcgtcagcatgcaagttcagacagtcacaaaattgaaaacagttactaatgttgttggatttgtaatgggcttgacatctccagaccggtatatcatagttggcagccatcatcacactgcacacagttataatggacaagaatgggccagtagtactgcaataatcacagcgtttatccgtgccttgatgtcaaaagttaagagagggtggagaccagaccgaactattgttttctgttcttggggaggaacagcttttggcaatattggctcatatgaatggggagaggatttcaagaaggttcttcagaaaaatgttgtggcttatattagcctccacagtcccataagggggaactctagtctgtatcctgtagcatcaccatctcttcagcaactggtagtagagaaaaataatttcaactgtaccagaagagcccagtgcccagaaaccaatatcagttctatacagatacaaggtgatgctgattatttcatcaaccatcttggagttcccatcgtgcagtttgcttacgaggacatcaaaacattagagggtccaagttttctctccgaggcccgtttttctacacgagcaacaaaaattgaagaaatggatccctctttcaaccttcatgaaaccattactaagctctcaggagaagtgattttgcaaattgccaacgaacctgttctgccctttaatgcacttgatatagctttagaagttcaaaacaaccttaaaggtgatcaacccaacactcatcaactgttagccatggcgttacgcctgcgggagagtgctgaactttttcagtctgatgagatgcgacctgctaatgatcccaaggagagagcacccatccgcatccggatgctgaatgacattctccaagacatggagaaaagctttctggtaaagcaggcaccaccaggtttttatagaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattgagaaaactctgagcatttttaaaagtttgtttacaattccacaagcaaaagctctaatttaaccagattttctgacattgaaggcttattttccccaatggctttttgacaagtataaagctattattacattgtattttttaaatgtaaatatagaaagaacattttgcacatttaatatttttcttatatctacatttctgaatatgtaaagcaagttattgaaataggacttaagaattacctattaaaaagaaatctgatatataaaaatatgtactattttaaggaaaaatttccaagaagttctggactatctttgttcctatggggagggcatataggaacacagtttattctctctgatagagctattaatgacttagtttctgtaaaagaaatggagagttgatatggttcagattaacttcactattaagtgttcaatatgaagaattcaagtattctgactgagtgattggttgacctaaaccactttgaatgtttctattttatgaaatgaagtttctcttcttaacacaactagatgtagtaatacactggttatgaaattgtatttttttaagtattaatgaaaaaagagccataagcattccaggagaaaatctcaagggagctacatagagcaatttaaatgcaaatttttttcctaacaacttacaaggtgactagctttgaaacccctaatttgcctcagttgattttctaagaatttcaggagtgatgtatgtcttaagagggagaaaaaaatatttcttattactttttctcttgtttctgttggaaacactgaagcagggactctaaaatgaaagcatctcacattggttttctttcttgtatcttttctgaaactccttgctgtaaggcagctttctcagagtactatatattttcaacagtaaagtagcagagtttctctttgaaacccaaaatgtcttctaaagaatcaaatttctatttctgcctctgacaaaaagaacttactatgaaagaaatagttgttttatcaataaaagccccttaatattatgaagaaacttttcatattttttcttctttatccttaattgtgactaagatggaaatctagaaaatattcatgcttctaagtttctgcagtgttactgtaagagagtgtctcgtctacacttcagttcttctctcatgtggaaaactaagctttttatattgacattgccattgaatagctctagcaactattattattcccccaaaccctaaaattctacctattaggtgtcaggttaaagttctaatttatctttagaaatttatgtgaaaaatggttttcctatactggataaagcaattccccttaggaaacatagcctcagagtatttcatataaattttctctatctaattcaaacatatctccccatgatacaccgccagagtgacattgcagacagtctgtgtatgtttaaattttcactttttatggatgagcataaacctagtcttagtttaaaggcaaactaaagttgaggggaaataattaatcaatactgattaattgatttataaggttcaacactgtctaccctaaataatttttatatgctcaaggcaaagcagggaatagaggcaattagctagataattcaagcagaaatccattttcatcgaaattgcctgtgtgcacatatttttagatgaaaaatgaaactaccttacaatattatttttttaaccaatgtatttgtttgcaaacatttgccatgttgaagagtgtgtataggaaaggtctagaaataaataggcttgtgcatacctaggcattcatgctctttcttcctcttcagagatcatcagaaaagaggtgggaatacacaagcaggtgcatgtaagcccaaaagctagaaagccttatatttaaccaaaggttgatgtgttcattccagttattcacttacagatgaaactaaaacaaataaaggcaagctattatcagtttggtagttcattattttagaacaaatttctaaattaatttattcccataacctacaatagcactgagaacagaaaacatgtttcttcttcattttgtttaaagattgcgtacctaggtaagtcacactgtatagataaaaaccttcttctgtattcctcacctctaaattatatgttatttgctatttgaaaactgtagttaactatggttttttattagtctattaaaagatacgtggagatattaaattatacctaaagcagacgtccaacaaattctgtacatgctgctttacatctttgcaacaaacctcttaactagcagcattatttctatagtgtgattacctgagggtgcctccaaatgtatatcatttcactcccctcccctccccacccccaatagattcaaataaataaaatcctgagcaaattaa

SEQ ID NO: 157268 - DNA, 3694 bp, Homo sapiens
  Payload ID: 10826
  Gene Symbol: NAGA
  Gene Name: N-acetylgalactosaminidase, alpha-
  Uniprot ID: P17050
  ENST ID: ENST00000396398
  CDS Start-End: 534-1769
ctggaacgcttcggacttatcaggttaccggattcgagtcagaagcggcggcaggtctgaacgcttcggtaggataagtgcggtgggagggggctctgcggttttggggagcccagggcgggaacccggacccggctggaagtccggagcctggccgcagccccgcccctccgctctttcttggtgaccttaagccagtggctgcctttttctgagcccgggcggggccgaaggcggcccgtaggccctcgggactcccagcactgcagagggtgtgaggtctgacatccaagacacgttgtttcgtatttctgaaggaagaactgaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccggatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccctcaggtcaccaataaacctgttctttaatcaagtagttgtaatatggacctggggtacctttagttagggactctggtggcactacacggggtgctggattcaaatctcacctctatggatgatgtctggcatcgtctggcccctccttttccaaagtgaccagaagattgtacttcctagagatgccagacttgcctcacacccaggagctgcccctgctgtgcctggtatgctggcagtggtgatggtgacaacacaatgaggccaagtagcaatgctcccaggtcctgcagcttgtgctctgcccagcagtgcccctggcccagcacctcagcctgctcttctctctggtggctccaccccaacccctacttcttttcctttatttctctcccaacctggctgcaaaggaggttcatattccccagatgtgtccacaaacctgtccaggagttgtgtcttaaaattgatttcctgtccctcttcctaaggacaggggtaacagtcaaagtgaaggaatgatgggttcttgcctgtcttgctttggtccgtatttcccaagccctcctcttttagccaaggctacagggcacttgtcttccctggtggctctcccctttggagagagctagtggcagagcaacctagctaggtcctccttgggctttgaatgcaggagcacccagtgccccaggccttgcactgtgctgcccaaggagtattttctgggtggatctcccatactcctcagggttctgaggtccttgtatttagggtatggtgtaaaaacttacatatgcacattttgttacatcatttaagatgattgaagctttactggttaagtatagggtcaccagagaaagttcctttccccagttgatgtcttgaggctgttgagaaacttaggacagaagcctacctcatcccaggcctgcccctccgtgcatagctctgcctttgggtcttgttcatagtgctgttcaggcaaaatggaatagtctcaggtgggaacaccttctcttgctagctccaggaaggctttgtgggaaatgagttgagaccatggacttgggagttgggggccagagttgagcctggacttgaccaattaattcccttacctttcagcccaagatagctacatgtctttacttgctgtataagttttccttttgtcctgggggtgcctgattgatcctatctcttcacccttcattctttcaacaaacatgccatctatctcccaggacatttattcccttctattcaaggccagttaggaatgcaattatttttttttttcagttaaatacagacttgtttggacgcaaggtaccctttctctttttaaaaactttttatcatgaaaactttcaaatacaaaaataaaatggtagagtgaacctccatgtacccagcatccagctccagtaaccat

SEQ ID NO: 157269 - DNA, 1869 bp, Homo sapiens
  Payload ID: 10826
  Gene Symbol: NAGA
  Gene Name: N-acetylgalactosaminidase, alpha-
  Uniprot ID: P17050
  ENST ID: ENST00000402937
  CDS Start-End: 157-1392
gccccgccctcactggaacgcttcggacttatcaggttaccggattcgagtcagaagcggcggcaggtctgaacgcttcgcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccggatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttg

SEQ ID NO: 157270 - DNA, 1856 bp, Homo sapiens
  Payload ID: 10826
  Gene Symbol: NAGA
  Gene Name: N-acetylgalactosaminidase, alpha-
  Uniprot ID: P17050
  ENST ID: ENST00000403363
  CDS Start-End: 138-1373
ctggaacgcttcggacttatcaggttaccggattcgagtcagaagcggcggcaggtctgaacgcttcgagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccggatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggagcgggcccaggggtaccccaagatggctgctgccctgaatgccacaggccgccccatcgccttctcctgcagctggccagcctatgaaggcggcctccccccaagggtgaactacagtctgctggcggacatctgcaacctctggcgtaactatgatgacatccaggactcctggtggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggtagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcatgtgattggcttttctacccatagagggccttgcagcctgataccacctgggagtgagggtcacaaaggagaccttggctccc

SEQ ID NO: 157271 - DNA, 1154 bp, Homo sapiens
  Payload ID: 10827
  Gene Symbol: NAGK
  Gene Name: N-acetylglucosamine kinase
  Uniprot ID: Q9UJ70
  ENST ID: ENST00000244204
  CDS Start-End: 63-1097
gaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaa

SEQ ID NO: 157272 - DNA, 1778 bp, Homo sapiens
  Payload ID: 10827
  Gene Symbol: NAGK
  Gene Name: N-acetylglucosamine kinase
  Uniprot ID: Q9UJ70
  ENST ID: ENST00000455662
  CDS Start-End: 246-1418
actgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaattggactgcattatcaaacacatgtgctatgtacatcctcagtgcacctgccagcagatatcctggagggctcatgagtgaatttagtccaagatttaaagccctgcccccaggtgctcagcctgtgatctgtatccactcagcatgcacttgggcagatgatttgtctgtgtgctacccttccccccatattaccatacatatgcactgtgtggctgccagttaat

SEQ ID NO: 157273 - DNA, 2343 bp, Homo sapiens
  Payload ID: 10827
  Gene Symbol: NAGK
  Gene Name: N-acetylglucosamine kinase
  ENST ID: ENST00000418807
  CDS Start-End: 165-1046
acgggaagtggggcggtgcccagacagctggagggaaggaggtgtcaggcggggagagacgcaaacggcgggaccagcagcgacggtagcagcagcatggccgcgatctatgggggtgtagagggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaattggactgcattatcaaacacatgtgctatgtacatcctcagtgcacctgccagcagatatcctggagggctcatgagtgaatttagtccaagatttaaagccctgcccccaggtgctcagcctgtgatctgtatccactcagcatgcacttgggcagatgatttgtctgtgtgctacccttccccccatattaccatacatatgcactgtgtggctgccagttaatctgtgacctgttttctcctgtcgtgtcaagtgggtaacgatccctggcgaccacagtcagcagaaacaagtgctcaccattcagaacatcacagggagtaaccttaggtatatcacaccctctcctgagactcccagcaagatttaggggctagagtacaattctagactgggagcatctttacctcactggatttagtaactgcaggtaagcaggacattttgaagtttttcctatgaatgagtttttgaaaggttatgaggatggctgagatccaagaagaccaactaggtaccgctcacctcggtagctgacctattcctggctactactagcctggctctgcttacagcgtgacactatgtgttgtgtgttcctgggaatgaggagcatcagtgaagagcagacatgattcctgccctctgggtaccatagttcagccagtgaaggcaaacctgaagcttcggttccacagcctgtgctgcttggtgaagactaaggacaggagtctcgatccacaatagctgcctctccaggtgttttattagaggcatgtggatcatgtcctgcacatcagttctccaacttacagacatcagttattctagagtttgttttaaaacacggttttggccgggcacggtggctcacgcctgtaatcccagcactttgggaggccgaggcaggtggatcacgaggtcaggagattgagaccatcctggctaacacggtgaaactccatctctactaaaaaatacaaaaaattaaccgggcgtggtgtcgcgcgcctgtagtcccagctactggggaggctgaggcaggagaatggcatgaacccaggaggtggagcttgcagtgagccgaggtcgcaccactgcactccagcctgggcgacagagcgagactctgcctcaaaaaataataaataaaaataaaa

SEQ ID NO: 157274 - DNA, 1833 bp, Homo sapiens
  Payload ID: 10827
  Gene Symbol: NAGK
  Gene Name: N-acetylglucosamine kinase
  ENST ID: ENST00000450272
  CDS Start-End: 38-517
cgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagccttggctcactgagcccttggggcttcctggggacaactcctgaacctggccattccatgtgcaggatcatgactgagatcatagaggtgcaaatgctggacgagctgctgaccctgctctccagcagtgacttgcacccaggactcagattcatccctcagcacaggggcctgcctgtgttgacttgctgtccttagggaggagttgaaactgagggtaaggccatagatgccaggagatgccataccagtctgctaggggaaagggtgtagaagcccttccaacatcacctctctctaggtagtgtgtgtttattttcataggggcccttgaggtccagttcatggcagtgactccggtggtatttgtgacaacagactgaccttgccttatccttgggtaggagctggtgtgacacagcctcacctattctgttttccccctccaactttcccttatcttggtcagtcagatacagtttgatagagaccctcccacccccctctcccaccccctgccacccctggctgggaatcaggaaacctaatttgtataaaattcaagcagatcactaacctgtctggatctgagtttccctcctcgtgagctcaggatgactgctcccatcttcttagccctctctgctccctgcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaaga

SEQ ID NO: 157275 - DNA, 878 bp, Homo sapiens
  Payload ID: 10827
  Gene Symbol: NAGK
  Gene Name: N-acetylglucosamine kinase
  ENST ID: ENST00000443872
  CDS Start-End: 211-801
gaagtggggcggtgcccagacagctggagggaaggaggtgtcaggcggggagagacgcaaacggcgggaccagcagcgacggtagcagcagcatggccgcgatctatgggggtgtagaggggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttc

SEQ ID NO: 157276 - DNA, 763 bp, Homo sapiens
  Payload ID: 10827
  Gene Symbol: NAGK
  Gene Name: N-acetylglucosamine kinase
  ENST ID: ENST00000455197
  CDS Start-End: 231-410
cgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagagggggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccag

SEQ ID NO: 157277 - DNA, 1221 bp, Homo sapiens
  Payload ID: 10827
  Gene Symbol: NAGK
  Gene Name: N-acetylglucosamine kinase
  ENST ID: ENST00000443938
  CDS Start-End: 66-1088
agggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccgggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaa

SEQ ID NO: 157278 - DNA, 463 bp, Homo sapiens
  Payload ID: 10827
  Gene Symbol: NAGK
  Gene Name: N-acetylglucosamine kinase
  ENST ID: ENST00000529236
  CDS Start-End: 1-411
gatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctct

SEQ ID NO: 157279 - DNA, 776 bp, Homo sapiens
  Payload ID: 10827
  Gene Symbol: NAGK
  Gene Name: N-acetylglucosamine kinase
  ENST ID: ENST00000533981
  CDS Start-End: 525-776
cagcagcgacggtagcagcagcatggccgcgatctatgggggtgtagaggggtgagtgcggcccggcggagggagcctgggcccgaaggcggggcggaaggccgtggccagcctggcaagctggtggccttgatcctcggcgtccgggcactttgggcggcgggaccttgcggtgaagaggtgtgtgcacgcgcaggggcgccctggagcgcacagctgtatgccttacggggactctgcctgtgcaacagccacaccccgggttggggatcctttgtgtttcttggcggaaccacgcccctttcttccacgaaacacccactccgctgtcttcagctggagaagcagctcctttttcctattcctgacctcggacagagttttgcagaacaggtgtcaggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaac

SEQ ID NO: 157280 - DNA, 797 bp, Homo sapiens
  Payload ID: 10827
  Gene Symbol: NAGK
  Gene Name: N-acetylglucosamine kinase
  ENST ID: ENST00000524736
  CDS Start-End: 1-548
gatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaag

SEQ ID NO: 157281 - DNA, 584 bp, Homo sapiens
  Payload ID: 10827
  Gene Symbol: NAGK
  Gene Name: N-acetylglucosamine kinase
  ENST ID: ENST00000531934
  CDS Start-End: 303-584
gcaacttccgggcgtttacaggcaggcaggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctg

SEQ ID NO: 157282 - DNA, 453 bp, Homo sapiens
  Payload ID: 10827
  Gene Symbol: NAGK
  Gene Name: N-acetylglucosamine kinase
  ENST ID: ENST00000524537
  CDS Start-End: 1-328
agaggcggctcctcatgatatcggctacgtcaaacaggccatgttccactatttccaggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatcca

SEQ ID NO: 157283 - DNA, 1801 bp, Homo sapiens
  Payload ID: 10827
  Gene Symbol: NAGK
  Gene Name: N-acetylglucosamine kinase
  Uniprot ID: Q9UJ70
  ENST ID: ENST00000613852
  CDS Start-End: 269-1441
gcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcgccccgccccgcgcatgcgcacgcgcacagggagtcagctggctgcgcgggaggtcacgggaagtggggcggtgcccagacagctggagggaaggaggtgtcaggcggggagagacgcaaacggcgggaccagcagcgacggtagcagcagcatggccgcgatctatgggggtgtagaggggggaggcacacgatccgaggtccttttagtctcagaggatgggaagatcctggcagaagcagatggactgagcacaaaccactggctgatcgggacagacaagtgtgtggagaggatcaatgagatggtgaacagggccaaacggaaagcaggggtggatcctctggtaccgctgcgaagcttgggcctatctctgagcggtggggaccaggaggacgcggggaggatcctgatcgaggagctgagggaccgatttccctacctgagtgaaagctacttaatcaccaccgatgccgccggctccatcgccacagctacaccggatggtggagttgtgctcatatctggaacaggctccaactgcaggctcatcaaccctgatggctccgagagtggctgcggcggctggggccatatgatgggtgatgagggttcagcctactggatcgcacaccaagcagtgaaaatagtgtttgactccattgacaacctagaggcggctcctcatgatatcggctacgtcaaacaggccatgttccactatttccaggtgccagatcggctagggatactcactcacctgtatagggactttgataaatgcaggtttgctgggttttgccggaaaattgcagaaggtgctcagcagggagaccccctttcccgctatatcttcaggaaggctggggagatgctgggcagacacatcgtagcagtgttgcccgagattgacccggtcttgttccagggcaagattggactccccatcctgtgcgtgggctctgtgtggaagagctgggagctgctgaaggaaggttttcttctggcgctgacccagggcagagagatccaggctcagaacttcttctccagcttcaccctgatgaagctgaggcactcctccgctctgggtggggccagcctaggggccaggcacatcgggcacctcctccccatggactatagcgccaatgccattgccttctattcctacaccttttcctagggggctggtcccggctccaccccctccaagctcagtggacactgggtctgaaaggaaggagtcttttgcttcctttctcctttttacaaaaacaaacatagaagaaaataaatgcactttatccactccccaattggactgcattatcaaacacatgtgctatgtacatcctcagtgcacctgccagcagatatcctggagggctcatgagtgaatttagtccaagatttaaagccctgcccccaggtgctcagcctgtgatctgtatccactcagcatgcacttgggcagatgatttgtctgtgtgctacccttccccccatattaccatacatatgcactgtgtggctgccagttaat

SEQ ID NO: 157284 - DNA, 5701 bp, Homo sapiens
  Payload ID: 10828
  Gene Symbol: GNPTAB
  Gene Name: N-acetylglucosamine-1-phosphate transferase, alpha and beta subunits
  Uniprot ID: Q3T906
  ENST ID: ENST00000299314
  CDS Start-End: 264-4034
agacccgggcggcgccggccgcctcgccggccgcaggtccgcctccgccgcgccgagggcgtgggctcccggctcccggaagcggcggccgcggcgcggagccgagcgggcgtccgtcgccggagctgcaatgagcggcgcccggaggctgtgacctgcgcgcggcggcccgaccggggcccctgaatggcggctcgctgaggcggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggctttgtctgcccatgccgattgacgttgtttacacctgggtgaatggcacagatcttgaactactgaaggaactacagcaggtcagagaacagatggaggaggagcagaaagcaatgagagaaatccttgggaaaaacacaacggaacctactaagaagagtgagaagcagttagagtgtttgctaacacactgcattaaggtgccaatgcttgtcctggacccagccctgccagccaacatcaccctgaaggacctgccatctctttatccttcttttcattctgccagtgacattttcaatgttgcaaaaccaaaaaacccttctaccaatgtctcagttgttgtttttgacagtactaaggatgttgaagatgcccactctggactgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactgttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggaaacagtggagggagtcgctatattgcaggaggtggaggtactgggagtattggagttggacagccctggcagtttggtggaggaataaacagtgtctcttactgtaatcagggatgtgcgaattcctggctcgctgataagttctgtgaccaagcatgcaatgtcttgtcctgtgggtttgatgctggcgactgtgggcaagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttttgtctgaca

SEQ ID NO: 157285 - DNA, 760 bp, Homo sapiens
  Payload ID: 10828
  Gene Symbol: GNPTAB
  Gene Name: N-acetylglucosamine-1-phosphate transferase, alpha and beta subunits
  ENST ID: ENST00000392919
  CDS Start-End: 169-384
gcggagccgagcgggcgtccgtcgccggagctgcaatgagcggcgcccggaggctgtgacctgcgcgcggcggcccgaccggggcccctgaatggcggctcgctgaggcggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggtctgtgaggtaaagggaatttcatccccctgtaggatgaggaaaccaggtggctactacacagcggtttctgagccctggccggaattctgttgacagcgtcctgtgaaatgggaccactccccagtaaaccactggggctgaaccccactccattggtcactcttgctgcttacctatgagggaggagcaaatagcctcatacctcattagtgtgggtctttcccttggaaggccaagcttcttagtgccgccattctggaacgcagtcttcaccatttcttgtctttggggattttttttttcctcttcacaagacagacctcagaatggaaacaatttttttcaacaccctccttccctttttgcagataaaatgaatcacacaa

SEQ ID NO: 157286 - DNA, 1678 bp, Homo sapiens
  Payload ID: 10828
  Gene Symbol: GNPTAB
  Gene Name: N-acetylglucosamine-1-phosphate transferase, alpha and beta subunits
  Uniprot ID: Q3T906
  ENST ID: ENST00000549940
  CDS Start-End: 144-1616
cggagctgcaatgagcggcgcccggaggctgtgacctgcgcgcggcggcccgaccggggcccctgaatggcggctcgctgaggcggcggcggcggcggcggcggctcaggctcctcggggcgtggcgtggcggtgaaggggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggctttgtctgcccatgccgattgacgttgtttacacctgggtgaatggcacagatcttgaactactgaaggaactacagcaggtcagagaacagatggaggaggagcagaaagcaatgagagaaatccttgggaaaaacacaacggaacctactaagaagagtgagaagcagttagagtgtttgctaacacactgcattaaggtgccaatgcttgtcctggacccagccctgccagccaacatcaccctgaaggacctgccatctctttatccttcttttcattctgccagtgacattttcaatgttgcaaaaccaaaaaacccttctaccaatgtctcagttgttgtttttgacagtactaaggatgttgaagatgcccactctggactgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactgttgcagttgtattcagaggccagtgtagcgcttctaaaactgaataaccccaaggattttcaagaattgaataagcaaactaagaagaacatgaccattgatggaaaagaactgaccataagtcctgcatatttattatgggatctgagcgccatcagccagtctaagcaggatgaagacatctctgccagtcgttttgaagataacgaagaactgaggtactcattgcgatctatcgagaggcatgcaccatgggttcggaatattttcattgtcaccaacgggcagattccatcctggctgaaccttgacaatcctcgagtgacaatagtaacacaccaggatgtttttcgaaatttgagccacttgcctacctttagttcacctgctattgaaagtcacattcatcgcatcgaagggctgtcccagaagtttatttacctaaatgatgatgtcatgtttgggaaggatgtctggccagatgatttttacagtcactccaaaggccagaaggtttatttgacatggcctgtgccaaactgtgccgagggctgcccaggttcctggattaaggatggctattgtgacaaggcttgtaataattcagcctgcgattgggatggtggggattgctctggtaaggatgtgttaaactgtaattcgttcatttttatggaatattttcttcttaatcattattgaacatgtgctatagacttaaccaaacattctttatgtattaataaagaatcagtaatgctggg

SEQ ID NO: 157287 - DNA, 2267 bp, Homo sapiens
  Payload ID: 10828
  Gene Symbol: GNPTAB
  Gene Name: N-acetylglucosamine-1-phosphate transferase, alpha and beta subunits
  ENST ID: ENST00000552681
  CDS Start-End: 1-417
gagaagcagttagagtgtttgctaacacactgcattaaggtgccaatgcttgtcctggacccagccctgccagccaacatcaccctgaaggacctgccatctctttatccttcttttcattctgccagtgacattttcaatgttgcaaaaccaaaaaacccttctaccaatgtctcagttgttgtttttgacagtactaaggatgttgaagatgcccactctggactgcttaaaggaaatagcagacagacagtatggaggggctacttgacaacagataaagaagtccctggattagtgctaatgcaagatttggctttcctgagtggatttccaccaacattcaaggaaacaaatcaactaaaaacaaaattgccagaaaatctttcctctaaagtcaaactggtaagaacatagaaaatagagcaattagcctggcacattctcatttaatgtgtgattcttttcttgtggtccatttttttcccccaaagtttagctgataaacataagaagcaaagagggattctgttctgccagaagagcctcactccttacttttaatttgggcaaaaatctaagagtcttatttggtttgcttgtttcctggatagagaaggactcatttgtttaacagatgagctcctacaatgtctcccatccaagtagtaaccaggcccaaccctgcttagcttccgagatcagacaagatcgggtgcgttcagggtggtatggccgtagacgagctcctacaatgtcttaggtgacattacagctgctggggatgcagcagtggacaaaacagacaaaggcccggatggaacttagggtgtgaacaatggaagcatgggaggaggagatgaggggaagtcataaatgtcatcaatgcacacagcctgttgtttacccaaagctttcactcataaaggtagtgtgcttcagatacatggaacatctgctaatgagaaccattcattagtaactaattgagggacaaatgtatttaaaatttatacttattagctcttcaggcttgaccattgatgccacttgttaaggtggactctggaggctggcctgggacgtgccttttccttaacatgtattgttttcagatcctttatctgattgacttaggacatagtccatgtgggtgttctctctatttgaccttacgtcaagatgcctgctattctgtcagaggtgtttcaggttgtaaatcgtgaatgtcccatctcttagagtagagagcataaagtccttgtctcagaatttgtgaggctctagttttcctgattttataaagaaatgttctttgagttctgccactgggtttagcttacctgattcttacttcctcctgttgtatgtcatttaacaattttgagggtgaaaggatgaagatggagtagtggtgggggagctgtgattagaggtgactagagagcagtttttacttagttcctgtcttaaccatgtttttatatgcaccccccaaccaaattccttttaacttgtttctccctaccccagaccaagtgttttactgttttatgatacattgtattatccttgtaatacaatggtaatgtgaataaccacttatgaattttttacttttttcatatttttcttcatagctttttttttttggagagagtcttgctctgtcacccaggctggagtgcagtggtgcgatctgggcacactgcaacctctgcctcccgggttcaaatgattctcctgcctcagcctccaaatagctgggattacaggcatgcgccaccatgcctggctaatttttgtattttaagtagagagggggtttcgccgtgttgaccaggctggtctccaactcctgacctcaggtgatcccctcaccttggcctcccaaagtgctgggattacaggcgtgagccactgctccttgcccttcatgactttctttattgtactttgaaatactgtaatgcctggctatattagagttgaatttgttcttaaatgcagttattttagaatagataatacatctctccttcctctgagttatttttagtactgatttggacagataaaaccatagattaactttcatttcagccaatgtttatttgacttcttggcttcctggttattagttctagaattatagacacatgtatatctgtacttttgaccaccagttcaacttgcttatgtagacagaatggcattcttgattctatttatataatttcaataaaataaatgctgaaaagaaagaa

SEQ ID NO: 157288 - DNA, 598 bp, Homo sapiens
  Payload ID: 10828
  Gene Symbol: GNPTAB
  Gene Name: N-acetylglucosamine-1-phosphate transferase, alpha and beta subunits
  ENST ID: ENST00000550718
  CDS Start-End: 1-352
tgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggatctcactctgttgtccaagctggaatgcagtaatgcaaacatggctcactgtagcctcgacctcgtgggctcaagcaatcctcccacctcagcctcctgactagtggaaccacagacatgagctgctgcacccagctaaaatggagtatttttaatttctgggtcttttaaatgcatttggaggtctttagttttacctcactgaaattaggattttaattataaataatcaaagatgtgaaccttacagacattttaaagccattatattttttctataaaccctgttctcgtttggaggagaaagaaattggaattttcaaaaaaaataaaaatacctttaacaccta

SEQ ID NO: 157289 - DNA, 550 bp, Homo sapiens
  Payload ID: 10828
  Gene Symbol: GNPTAB
  Gene Name: N-acetylglucosamine-1-phosphate transferase, alpha and beta subunits
  ENST ID: ENST00000549738
  CDS Start-End: 1-291
ccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggatctcactctgttgtccaagctggaatgcagtaatgcaaacatggctcactgtagcctcgacctcgtgggctcaagcaatcctcccacctcagcctcctgactagtggaaccacagacatgagctgctgcacccagctaaaatggagaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaa

SEQ ID NO: 157290 - DNA, 373 bp, Homo sapiens
  Payload ID: 10828
  Gene Symbol: GNPTAB
  Gene Name: N-acetylglucosamine-1-phosphate transferase, alpha and beta subunits
  ENST ID: ENST00000549165
  CDS Start-End: 5-211
ggtgatgctgttcaagctcctgcagagacagacctatacctgcctgtcccacaggtatgggctctacgtgtgcttcttgggcgtcgttgtcaccatcgtctccgccttccagttcggagaggtggttctggaatggagccgagatcaataccatgttttgtttgattcctatagagacaatattgctggaaagtcctttcagaatcggtaagatctattttggagaaatctattatttggacctaaatcgtaagtcatgaaatagccatcctgtaaatatgacagtttaaggggtctttctgagttatagatatggtttaatttactcaggagtatgcccatctgatgtgttcactttagcagcacatatact

SEQ ID NO: 157291 - DNA, 1983 bp, Homo sapiens
  Payload ID: 10829
  Gene Symbol: GNPTG
  Gene Name: N-acetylglucosamine-1-phosphate transferase, gamma subunit
  Uniprot ID: Q9UJJ9
  ENST ID: ENST00000204679
  CDS Start-End: 44-961
tgaccgtcacttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgacgttcgagacccccctcgtctgccacccccacgccttgctagtgtacccaaccctgccagaggccctgcagcggcagtgggaccaggtagagcaggacctggccgatgagctgatcaccccccagggccatgagaagttgctgaggacactttttgaggatgctggctacttaaagaccccagaagaaaatgaacccacccagctggagggaggtcctgacagcttggggtttgagaccctggaaaactgcaggaaggctcataaagaactctcaaaggagatcaaaaggctgaaaggtttgctcacccagcacggcatcccctacacgaggcccacagaaacttccaacttggagcacttgggccacgagacgcccagagccaagtctccagagcagctgcggggtgacccaggactgcgtgggagtttgtgaccttgtggtgggagagcagaggtggacgcggccgagagccctacagagaagctggctggtaggacccgcagggaccagctgaccaggcttgtgctcagagaagcagacaaaacaaagattcaaggttttaattaattcccatactgataaaaataactccatgaattctgtaaaccattgcataaatgctatagtgtaaaaaaatttaaacaagtgttaactttaaacagttcgctacaagtaaatgattataaatactaccttctgggttaagaaaattccattcaaataacattctcatgtaaatactcaaacatacagattgaggcttccagaaattaatccacttgaggcgtccacgcggaacaaggtctgctgaccacagttacacacgtcgtgacaccactgtatcacggcgaatgtcgaacactagagttacagacgacaggcaacaagaacatgcagagccggccgccagccagctcctacgccccgtgcccgccatggccacaggggggagctgctgggcgcgcctccacctcagcctccacggggcaccttccagccactgctgtgcctcagccacctaggagccatccctgaggccatggccaccaagacaggtgagggaggccccagggcacacagccccaggatcttgcccccatttccaaccctggcagcgctgccagccattctttggtcttcccactgctcacctgtcctcagagccagtactgatctaggggagcaggtgccacctccatctcccagctgtccccccacccctggggctccccagctctaccaccccggaagctgagccctggagacaccctgaggggcgggcgccacctccttcccagaaagagcagagcagctggcagactagagctcagctgctcctgaccactgacaaccgggagatgtctcggcagacaccacttatcccagaaaagaccagaggctccaaatgggaaccaagtgcataaatacaaataaaaacagagtttacacatcga

SEQ ID NO: 157292 - DNA, 572 bp, Homo sapiens
  Payload ID: 10829
  Gene Symbol: GNPTG
  Gene Name: N-acetylglucosamine-1-phosphate transferase, gamma subunit
  ENST ID: ENST00000526820
  CDS Start-End: 36-266
acttcacgtgaccgcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctgagacggggtttcaccgtgttagccaggacggtctcgatctcctgacctcgtgatctgcccgcctcggcctcccacagtgctgggatgacagtcatgagccaccgcgcctggcctcgactttattattaatacggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggca

SEQ ID NO: 157293 - DNA, 552 bp, Homo sapiens
  Payload ID: 10829
  Gene Symbol: GNPTG
  Gene Name: N-acetylglucosamine-1-phosphate transferase, gamma subunit
  ENST ID: ENST00000529110
  CDS Start-End: 1-552
gcggctcctgttgctcctcgggctctcggccggcggtgagtggcccggccgtccgcgtccccaggccccgcgcgcgctctgcaccccggcctccccgctcacggtctcgctccccgtagggcccgcgccggcaggtgcagcgaagatgaaggtggtggaggagcccaacgcgtttggggtgaacaacccgttcttgcctcaggccagtcgcctccaggccaagagggatccttcacccgtgtctggacccgtgcatctcttccgactctcgggcaagtgcttcagcctggtggagtccacgtacaagtatgagttctgcccgttccacaacgtgacccagcacgagcagaccttccgctggaacgcctacagtgggatcctcggcatctggcacgagtgggagatcgccaacaacaccttcacgggcatgtggatgagggacggtgacgcctgccgttcccggagccggcagagcaaggtggagctggcgtgtggaaaaagcaaccggctggcccatgtgtccgagccgagcacctgcgtctacgcgctgac

SEQ ID NO: 157294 - DNA, 550 bp, Homo sapiens
  Payload ID: 10829
  Gene Symbol: GNPTG
  Gene Name: N-acetylglucosamine-1-phosphate transferase, gamma subunit
  ENST ID: ENST00000527876
  CDS Start-End: 23-253
gcgcggcggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctgagacggggtttcaccgtgttagccaggacggtctcgatctcctgacctcgtgatctgcccgcctcggcctcccacagtgctgggatgacagtcatgagccaccgcgcctggcctcgactttattattaatacggcgctggtgacactgccctgcaaccgtcagcaccatcatctccacaacttgctctgtccccttcaaaccctgactcccagctgccccgctcccccagccccggcacccaccattctgctgtctctgaacttggctattcatagacgtcacataggtgactcataactgtgtgcgaccttttgtgtctgaccaactcctcttggcacagtgtccccaa

SEQ ID NO: 157295 - DNA, 386 bp, Homo sapiens
  Payload ID: 10829
  Gene Symbol: GNPTG
  Gene Name: N-acetylglucosamine-1-phosphate transferase, gamma subunit
  ENST ID: ENST00000527137
  CDS Start-End: 16-201
ggccgctgcggcgcgatggcggcggggctggcgcggctcctgttgctcctcgggctctcggccggcgggcccgcgccggcaggtgcagcgaagatgaaggtggtggaggagcccaacgcgtttggggtgaacaacccgttcttgcctcaggccagtcgcctccaggccaagagggatccttcacccgtgtctggtgagtgaggagcgctgttggccggcgcgggggtggccgcggggagcagcaacagtggaggatggatgagtgaccctgagagttacggcccggagtctaaagcattggtttgtcagccttctaaaattaatgtggaagtacgagagaatataccagaacgttcttgtagcgaattaaattatctccagactta

SEQ ID NO: 157296 - DNA, 2202 bp, Homo sapiens
  Payload ID: 10830
  Gene Symbol: NAGPA
  Gene Name: N-acetylglucosamine-1-phosphodiester alpha-N-acetylglucosaminidase
  Uniprot ID: Q9UK23
  ENST ID: ENST00000312251
  CDS Start-End: 21-1568
acccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtggacccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctggcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgagatcatgtttacagacctgttttgtcatcctgctgccaagaagttttttaatcacttgaataaattgatataataaaaggagccaccaggtggtgtgtggattctgaa

SEQ ID NO: 157297 - DNA, 2100 bp, Homo sapiens
  Payload ID: 10830
  Gene Symbol: NAGPA
  Gene Name: N-acetylglucosamine-1-phosphodiester alpha-N-acetylglucosaminidase
  Uniprot ID: Q9UK23
  ENST ID: ENST00000381955
  CDS Start-End: 21-1466
acccgaggccccggtccaatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtggacccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctggcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgagatcatgtttacagacctgttttgtcatcctgctgccaagaagttttttaatcacttgaataaattgatataataaaaggagccaccaggtggtgtgtggattctgaa

SEQ ID NO: 157298 - DNA, 2260 bp, Homo sapiens
  Payload ID: 10830
  Gene Symbol: NAGPA
  Gene Name: N-acetylglucosamine-1-phosphodiester alpha-N-acetylglucosaminidase
  Uniprot ID: Q9UK23
  ENST ID: ENST00000562746
  CDS Start-End: 5-934
caatatggcgacctccacgggtcgctggcttctcctccggcttgcactattcggcttcctctgggaagcgtccggcggcctcgactcgggggcctcccgcgacgacgacttgctactgccctatccacgcgcgcgcgcgcgcctcccccgggactgcacacgggtgcgcgccggcaaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtggacccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactggcaggcgtgatggtgcacaccttacggttacagctgctcaggaggctcgggtggaaggatcgcaatacctcatctcaaaaatagatagacgccatcttgtagccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagactggcaactgcagcgtctccagagtaaagcagtgtctccagccacctgaagccaccctgagggcgggagaactctcctttttcaccaggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctggcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgagatcatgtttacagacctgttttgtcatcctgctgccaagaagttttttaatcacttgaataaattgatataataaaagg

SEQ ID NO: 157299 - DNA, 615 bp, Homo sapiens
  Payload ID: 10830
  Gene Symbol: NAGPA
  Gene Name: N-acetylglucosamine-1-phosphodiester alpha-N-acetylglucosaminidase
  ENST ID: ENST00000562037
  CDS Start-End: 1-315
aaccgcgagcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtggacccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacct

SEQ ID NO: 157300 - DNA, 544 bp, Homo sapiens
  Payload ID: 10830
  Gene Symbol: NAGPA
  Gene Name: N-acetylglucosamine-1-phosphodiester alpha-N-acetylglucosaminidase
  ENST ID: ENST00000565876
  CDS Start-End: 1-121
gagcagctccggggggctgcagaacgcgcagttcgggatccgccgcgacgggaccctggtcaccggaatggggataggaatcgcttccttgcagagtttattcatcatccagtatcattgagcacttgcttgtatcaggcaatgtgccgcgccccggtgagatagccgtgaacaacacagtctttgccttaacagccctcccccattactagaaaaatcaacaaaagccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggagtgtccccttggctggcatgggccgggctgccagaggccttgtaagtgtgagcaccattgtcc

SEQ ID NO: 157301 - DNA, 866 bp, Homo sapiens
  Payload ID: 10830
  Gene Symbol: NAGPA
  Gene Name: N-acetylglucosamine-1-phosphodiester alpha-N-acetylglucosaminidase
  ENST ID: ENST00000569296
  CDS Start-End: 1-519
gtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactgctgctcaggaggctcgggtggaaggatcgcaatacctcatctcaaaaatagatagacgccatcttgtagccaggacaacatgtggcgctgtccccgccaagtgtccaccgtggtgtgtgtgcacgaaccccgctgccagccgcctgactgccacggccacgggacctgcgtggacgggcactgccaatgcaccgggcacttctggcggggtcccggctgtgatgagctggactgtggcccctctaactgcagccagcacggactgtgcacggagaccggctgccgctgtgatgccggatggaccgggtccaactgcagtgaagagtgtccccttggctggcatgggccgggctgccagaggccttgtaagtgtgagcaccattgtccctgtgaccccaagac

SEQ ID NO: 157302 - DNA, 1494 bp, Homo sapiens
  Payload ID: 10830
  Gene Symbol: NAGPA
  Gene Name: N-acetylglucosamine-1-phosphodiester alpha-N-acetylglucosaminidase
  ENST ID: ENST00000563578
  CDS Start-End: 1-946
cgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtggacccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacaggttcctttagcaaatttgtgaatgtgatatcagccaggacggccattggccacgaccggaaagggcagctggtgctctttcatgcagacggccaaacggagcagcgtggcatcaacctgtgggaaatggcggagttcctgctgaaacaggacgtggtcaacgccatcaacctggatgggggtggctctgccacctttgtgctcaacgggaccttggccagttacccgtcagatcactggaccgcctggctagccctcaccctggcgctggccttcctcctgctgatcagcactgcagcaaacctgtccttgctcctgtccagagcagagaggaaccggcgcctgcatggggactatgcataccacccgctgcaggagatgaacggggagcctctggccgcagagaaggagcagccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctggcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgagatcatgtttacagacctgttt

SEQ ID NO: 157303 - DNA, 570 bp, Homo sapiens
  Payload ID: 10830
  Gene Symbol: NAGPA
  Gene Name: N-acetylglucosamine-1-phosphodiester alpha-N-acetylglucosaminidase
  ENST ID: ENST00000562346
  CDS Start-End: 1-570
agcacgagagttggcctccgcctcccgcgactcccggcgccggcggtctggccgtgcgcaccttcgtgtcgcacttcagggaccgcgcggtggccggccacctgacgcgggccgttgagcccctgcgcaccttctcggtgctggagcccggtggacccggcggctgcgcggcgagacgacgcgccaccgtggaggagacggcgcgggcggccgactgccgtgtcgcccagaacggcggcttcttccgcatgaactcgggcgagtgcctggggaacgtggtgagcgacgagcggcgggtgagcagctccggggggctgcagaacgcgcagttcgggatccgccgcgacgggaccctggtcaccgggtacctgtctgaggaggaggtgctggacactgagaacccatttgtgcagctgctgagtggggtcgtgtggctgattcgtaatggaagcatctacatcaacgagagccaagccacagagtgtgacgagacacaggagacagccaggacaacatgtggcgctgtccccgccaagtgtccaccgtggtgtgtgtgcacgaaccccgctg

SEQ ID NO: 157304 - DNA, 2544 bp, Homo sapiens
  Payload ID: 10831
  Gene Symbol: NAGLU
  Gene Name: N-acetylglucosaminidase, alpha
  Uniprot ID: P54802
  ENST ID: ENST00000225927
  CDS Start-End: 102-2333
cccgggcttagccttcgggtccacgtggccggaggccggcagctgattggacgcgggccgccccaccccctggccgtcgcgggacccgcaggactgagaccatggaggcggtggcggtggccgcggcggtgggggtccttctcctggccggggccgggggcgcggcaggcgacgaggcccgggaggcggcggccgtgcgggcgctcgtggcccggctgctggggccaggccccgcggccgacttctccgtgtcggtggagcgcgctctggctgccaagccgggcttggacacctacagcctgggcggcggcggcgcggcgcgcgtgcgggtgcgcggctccacgggcgtggcggccgccgcggggctgcaccgctacctgcgcgacttctgtggctgccacgtggcctggtccggctctcagctgcgcctgccgcggccactgccagccgtgccgggggagctgaccgaggccacgcccaacaggtaccgctattaccagaatgtgtgcacgcaaagctactctttcgtgtggtgggactgggcccgctgggagcgagagatagactggatggcgctgaatggcatcaacctggcactggcctggagcggccaggaggccatctggcagcgggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccagggtgttccctcaggtcaatgtcacgaagatgggcagttggggccactttaactgttcctactcctgctccttccttctggctccggaagaccccatattccccatcatcgggagcctcttcctgcgagagctgatcaaagagtttggcacagaccacatctatggggccgacactttcaatgagatgcagccaccttcctcagagccctcctaccttgccgcagccaccactgccgtctatgaggccatgactgcagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagccgcgaggagacactgtggacctggccaagaagatcttcctcaaatattacccccgctgggtggccggctcttggtgatagattcgccaccactgggccttgttttccgctaattccagggcagattccagggcccagagctggacagacatcacaggataacccaggcctgggaggaggccccacggcctgctggtggggtctgacctggggggattggagggaaatgacctgccctccaccaccacccaaagtgtgggattaaagtactgttttctttccacttaaa

SEQ ID NO: 157305 - DNA, 634 bp, Homo sapiens
  Payload ID: 10831
  Gene Symbol: NAGLU
  Gene Name: N-acetylglucosaminidase, alpha
  ENST ID: ENST00000590358
  CDS Start-End: 390-634
ttgccttcctcccccaccttctctttgaacctgcggactgaggaaggacgcctccatcccccaccctacaggcctgtgttccagcgcctgccacactatggagtgatgtgttcacacagctgtcctcccctgcccatctgttagactgtgggggcagggattccccgttccaggaaaacaccgtgcagaggaggggctctggcagtgtggcatgaaagtggaatatgccacccaaatacccgccaggctagagggccctgggagagtgcaggggacgagtgcctcagaagcccagccccggtacctggtctcagctccacctggggtgggtcccagtgtgcagcagaagggccgagtttggagcccctcccctctcctctaggtgggggatgggggatttgttccagggccgtggaccctccagggtgggatgcgcccctgctcatgacactgcccgcaggtaccgctattaccagaatgtgtgcacgcaaagctactctttcgtgtggtgggactgggcccgctgggagcgagagatagactggatggcgctgaatggcatcaacctggcactggcctggagcggccaggaggccatctggcagcgggtgtacctggccttgggcctgaccca

SEQ ID NO: 157306 - DNA, 510 bp, Homo sapiens
  Payload ID: 10831
  Gene Symbol: NAGLU
  Gene Name: N-acetylglucosaminidase, alpha
  ENST ID: ENST00000586516
  CDS Start-End: 1-510
cggccgccgcggggctgcaccgctacctgcgcgacttctgtggctgccacgtggcctggtccggctctcagctgcgcctgccgcggccactgccagccgtgccgggggagctgaccgaggccacgcccaacaggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccagggtgttccctcaggtcaatgtcacgaagatgggcagttggggccactttaactgttcctactcctgctccttccttctggctccggaagaccccatattccccatcatcgggagcctcttcctgcgagagctgatcaaagagtt

SEQ ID NO: 157307 - DNA, 1493 bp, Homo sapiens
  Payload ID: 10831
  Gene Symbol: NAGLU
  Gene Name: N-acetylglucosaminidase, alpha
  ENST ID: ENST00000591587
  CDS Start-End: 1-369
cgcggggctgcaccgctacctgcgcgacttctgtggctgccacgtggcctggtccggctctcagctgcgcctgccgcggccactgccagccgtgccgggggagctgaccgaggccacgcccaacaggtgtacctggccttgggcctgacccaggcagagatcaatgagttctttactggtcctgccttcctggcctgggggcgaatgggcaacctgcacacctgggatggccccctgcccccctcctggcacatcaagcagctttacctgcagcaccgggtcctggaccagatgcgctccttcggcatgaccccagtgctgcctgcattcgcggggcatgttcccgaggctgtcaccagtggatactgaggctgtgtggctgctccaaggctggctcttccagcaccagccgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgtagcccgctggtcaggcggccgtccctacagatgaataccagcatctggtacaaccgatctgatgtgtttgaggcctggcggctgctgctcacatctgctccctccctggccaccagccccgccttccgctacgacctgctggacctcactcggcaggcagtgcaggagctggtcagcttgtactatgaggaggcaagaagcgcctacctgagcaaggagctggcctccctgttgagggctggaggcgtcctggcctatgagctgctgccggcactggacgaggtgctggctagtgacagccgcttcttgctgggcagctggctagagcaggcccgagcagcggcagtcagtgaggccgaggccgatttctacgagcagaacagccgctaccagctgaccttgtgggggccagaaggcaacatcctggactatgccaacaagcagctggcggggttggtggccaactactacacccctcgctggcggcttttcctggaggcgctggttgacagtgtggcccagggcatccctttccaacagcaccagtttgacaaaaatgtcttccaactggagcaggccttcgttctcagcaagcagaggtaccccagccagc

SEQ ID NO: 157308 - DNA, 582 bp, Homo sapiens
  Payload ID: 10831
  Gene Symbol: NAGLU
  Gene Name: N-acetylglucosaminidase, alpha
  ENST ID: ENST00000592454
  CDS Start-End: 1-196
gtttggcacagaccacatctatggggccgacactttcaatgagatgcagccaccttcctcagagccctcctaccttgccgcagccaccactgccgtctatgaggccatgactgcagttctgggggcccgcccagatcagggctgtgctgggagctgtgccccgtggccgcctcctggttctggacctgtttgctgagagccagcctgtgtatacccgcactgcctccttccagggccagcccttcatctggtgcatgctgcacaactttgggggaaaccatggtctttttggagccctagaggctgtgaacggaggcccagaagctgcccgcctcttccccaactccaccatggtaggcacgggcatggcccccgagggcatcagccagaacgaagtggtctattccctcatggctgagctgggctggcgaaaggacccagtgccagatttggcagcctgggtgaccagctttgccgcccggcggtatggggtctcccacccggacgcaggggcagcgtggaggctactgctccggagtgtgtacaactgctccggggaggcctgcaggggccacaatcgta

SEQ ID NO: 157309 - DNA, 2182 bp, Homo sapiens
  Payload ID: 10832
  Gene Symbol: NAGS
  Gene Name: N-acetylglutamate synthase
  Uniprot ID: Q8N159
  ENST ID: ENST00000293404
  CDS Start-End: 119-1723
cctgtccggaccccgccccgaccaggtccagccccgcccaacggcaagttaagagccccccagtgccagacgctccagacagactgccactcttggggggcaagagttggttgtcgtcatggcgacggcgctgatggctgtggttctgcgggcagctgctgtagccccgaggctgagaggccggggaggcactgggggcgcccgaaggctgagctgtggcgcgcggcggcgggcggcgaggggcaccagcccggggcgccggctcagcaccgcctggtcgcagccccagcccccgcccgaggagtacgcgggcgcggacgacgtctcccagtcgcccgtcgccgaggagccgtcgtgggtgccgagtcccaggcccccggtgccccacgagtccccagagcctccttcgggccgctcgctggtgcagcgggacatccaggccttcctgaaccagtgcggggccagccctggggaggcgcgccactggctcacgcagttccagacctgccatcactccgcggacaagcccttcgccgtcatcgaggtggacgaggaggtgctcaagtgccagcagggcgtatccagtctggcctttgccctggccttcttgcagcgcatggacatgaagccgctggtggtcctggggctgccggcccctacggctccctcgggctgtctttccttctgggaggccaaggcgcagctggccaagagctgcaaggtgctggtagacgcgcttcgacacaacgccgccgctgctgtgccattttttggcggcgggtctgtgctacgcgctgccgagccggctccccatgccagctacggcggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtcctgagtaacgtgaacctgcccgccgacctggacctggtgtgcaacgccgagtgggtgagcacaaaagaacggcagcagatgcggctcatcgtggacgtgctcagccgcctgccccaccactcctcggccgtcatcaccgccgctagcacgctgctcactgagctctttagcaacaaggggtccgggaccctgttcaagaacgccgagcgaatgctacgggtgcgcagcctggacaagctggaccagggccgtctagtggacctggtcaacgccagcttcggcaagaagctcagggacgactacctggcctcgctgcgcccgcggctgcactccatctacgtctccgaggggtacaacgccgccgccattctgaccatggagcccgtcctggggggcaccccgtacctggacaaatttgtggtgagctccagccgccagggccaaggctccggccagatgctgtgggagtgcctgcggcgggaccttcagacacttttctggcgctcccgggtcaccaaccccatcaatccctggtacttcaaacacagtgatggcagcttctccaacaagcagtggatcttcttctggtttggcctggctgatatccgggactcctatgagttggtcaaccacgccaagggactgccagactcctttcacaagccagcttctgacccaggcagctgaccctcaccatggacactacaggccctggaatggccagggtggaccaaaagccatgccagctgggcatgaccccaggcagccagccacaggctgaagggggcttgttggctgagtgatctgcagaggagaaagcagccccagctctgcccagaggaggcgctgaagtgggacaagcacaggaaagaaggggaccagtctaggaccccaactcgactcactctaaagctacaaccaaatggccttcgattttcaacctggggattaggggaggggagggtgccttccagggctctactcaggactaaccctaagggtgagctagtttctgtgcctctgtgctatgttttgaggctcccttacccaaaataatacccctgcctgcgtgatattctaccattcattttaattcctttgggtcttgcagtttttcaggaggccttgattaaaatgcaaatactt

SEQ ID NO: 157310 - DNA, 1995 bp, Homo sapiens
  Payload ID: 10832
  Gene Symbol: NAGS
  Gene Name: N-acetylglutamate synthase
  ENST ID: ENST00000589767
  CDS Start-End: 1-1536
agctgtggcgcgcggcggcgggcggcgaggggcaccagcccggggcgccggctcagcaccgcctggtcgcagccccagcccccgcccgaggagtacgcgggcgcggacgacgtctcccagtcgcccgtcgccgaggagccgtcgtgggtgccgagtcccaggcccccggtgccccacgagtccccagagcctccttcgggccgctcgctggtgcagcgggacatccaggccttcctgaaccagtgcggggccagccctggggaggcgcgccactggctcacgcagttccagacctgccatcactccgcggacaagcccttcgccgtcatcgaggtggacgaggaggtgctcaagtgccagcagggcgtatccagtctggcctttgccctggccttcttgcagcgcatggacatgaagccgctggtggtcctggggctgccggcccctacggctccctcgggctgtctttccttctgggaggccaaggcgcagctggccaagagctgcaaggtgctggtagacgcgcttcgacacaacgccgccgctgctgtgccattttttggcggcgggtctgtgctacgcgctgccgagccggctccccatgccagctacggcggcatcgtctcggtggagacagacctgctgcagtggtgcctggagtcgggcagcatccccatcctgtgccccatcggggagacggccgcgcgccgctccgtgcttctcgactccctggaggtgaccgcgtcgctggccaaggcgctgcggcccaccaaaatcatcttcctcaataacacaggcggcctgcgcgacagcagtcataaggtcctgagtaacgtgaacctgcccgccgacctggacctggtgtgcaacgccgagtgggtgagcacaaaagaacggcagcagatgcggctcatcgtggacgtgctcagccgcctgccccaccactcctcggccgtcatcaccgccgctagcacgctgctcactgagctctttagcaacaaggggtccgggaccctgttcaagaacgccgagcgaatgctacgggtgcgcagcctggacaagctggaccagggccgtctagtggacctggtcaacgccagcttcggcaagaagctcagggacgactacctggcctcgctgcgcccgcggctgcactccatctacgtctccgagggcctgccgctctcccgctgcgccaggtacaacgccgccgccattctgaccatggagcccgtcctggggggcaccccgtacctggacaaatttgtggtgagctccagccgccagggccaaggctccggccagatgctgtgggagtgcctgcggcgggaccttcagacacttttctggcgctcccgggtcaccaaccccatcaatccctggtacttcaaacacagtgatggcagcttctccaacaagcagtggatcttcttctggtttggcctggctgatatccgggactcctatgagttggtcaaccacgccaagggactgccagactcctttcacaagccagcttctgacccaggcagctgaccctcaccatggacactacaggccctggaatggccagggtggaccaaaagccatgccagctgggcatgaccccaggcagccagccacaggctgaagggggcttgttggctgagtgatctgcagaggagaaagcagccccagctctgcccagaggaggcgctgaagtgggacaagcacaggaaagaaggggaccagtctaggaccccaactcgactcactctaaagctacaaccaaatggccttcgattttcaacctggggattaggggaggggagggtgccttccagggctctactcaggactaaccctaagggtgagctagtttctgtgcctctgtgctatgttttgaggctcccttacccaaaataatacccctgcctgcgtgatattctaccattcattttaattcctttgggtcttgcagtttttcaggaggccttgattaaaatgcaaatactt

SEQ ID NO: 157311 - DNA, 2461 bp, Homo sapiens
  Payload ID: 10833
  Gene Symbol: NPL
  Gene Name: N-acetylneuraminate pyruvate lyase (dihydrodipicolinate synthase)
  Uniprot ID: Q9BXD5
  ENST ID: ENST00000258317
  CDS Start-End: 23-985
ttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 157312 - DNA, 745 bp, Homo sapiens
  Payload ID: 10833
  Gene Symbol: NPL
  Gene Name: N-acetylneuraminate pyruvate lyase (dihydrodipicolinate synthase)
  Uniprot ID: Q9BXD5
  ENST ID: ENST00000367552
  CDS Start-End: 23-745
ttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagttttgtatccagagatttatcaactttgttgtcaaactagaaaactcaaaactcaaagtttcaaagaaccaaaggactcttcctctgggcaccacaaacttccccttcctccactga

SEQ ID NO: 157313 - DNA, 2231 bp, Homo sapiens
  Payload ID: 10833
  Gene Symbol: NPL
  Gene Name: N-acetylneuraminate pyruvate lyase (dihydrodipicolinate synthase)
  Uniprot ID: Q9BXD5
  ENST ID: ENST00000367553
  CDS Start-End: 45-1007
acttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaa

SEQ ID NO: 157314 - DNA, 3027 bp, Homo sapiens
  Payload ID: 10833
  Gene Symbol: NPL
  Gene Name: N-acetylneuraminate pyruvate lyase (dihydrodipicolinate synthase)
  Uniprot ID: Q9BXD5
  ENST ID: ENST00000367554
  CDS Start-End: 646-1551
gcagacgaggcagggggaggtttgcactcggcgtggcgcgggtgagccgcgtgctctcgggcacccggccgccagttcggatgcttccgatcctcggggagccggggcgctgcgccggagtcacttcagcccatgttgttcaggtgacacccggggaagagcagactccagtgtgcaaaacgtttcggggtttccgggccagcggttccgggcgcgcctcgcgggcggcggcgcagaactacaacccccaggctccctggcgtggcggcacgtgggcccgagccgggcggccgcggatataaagcgcggcggcggctgccgggcggagcggctgcacggacaagagcggaggcctggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagtgagtggctgcatgaggataaaaatgccctttggcaacagctgtattcagtgagcctcttccccagaggatacgccctccctgcttcctggtcagagccggggcttgaggtcagctggtgggaagatgagcagggcccccgggatcctggcttcttggagaagagccccctccctttctgtgcagaagggcagccaaactgctagacacacctgccacccagaggttccgctgggaaactgcttcttacctgtctacaaggccagtcccctcacagttacccgtctttgggctgaaaggctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 157315 - DNA, 1536 bp, Homo sapiens
  Payload ID: 10833
  Gene Symbol: NPL
  Gene Name: N-acetylneuraminate pyruvate lyase (dihydrodipicolinate synthase)
  Uniprot ID: Q9BXD5
  ENST ID: ENST00000367555
  CDS Start-End: 109-831
gggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagttttgtatccagagatttatcaactttgttgtcaaactagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 157316 - DNA, 2376 bp, Homo sapiens
  Payload ID: 10833
  Gene Symbol: NPL
  Gene Name: N-acetylneuraminate pyruvate lyase (dihydrodipicolinate synthase)
  ENST ID: ENST00000614468
  CDS Start-End: 23-715
ttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttcta

SEQ ID NO: 157317 - DNA, 3964 bp, Homo sapiens
  Payload ID: 10834
  Gene Symbol: NANP
  Gene Name: N-acetylneuraminic acid phosphatase
  Uniprot ID: Q8TBE9
  ENST ID: ENST00000304788
  CDS Start-End: 228-974
ggcgccgacacacgtttccagggctcttgagagaccataccctgggagtctcgcgggatctcacttttctcggcggcgcagggaatgagacagatcgcgggaattccacccgcgccgggagatggtctggtgacttcgcggctcctcccacgtctctctgggcagtccgccttgcgcatgcgcaggcggcggtggcaaggctacggttcgcgccagcggccggcgctatggggctgagccgcgtgcgggcggttttctttgacttggacaacactctcatcgacacggccggggcgagcaggagaggcatgttggaggtgataaaactcttacaatcaaaataccattataaagaagaggctgaaatcatctgtgataaagttcaagttaaactcagcaaggaatgttttcatccttacaatacatgcattactgatttaaggacttcacattgggaagaagcaatccaggaaacaaaaggtggtgcagccaatagaaaattggctgaagaatgttatttcctttggaaatctacacgtttacagcatatgacactagcagaagacgtcaaagccatgcttactgaacttcgaaaggaggtccgcctacttctattaacgaatggggacagacagacccagagggagaagattgaggcttgtgcctgtcagtcctattttgacgctgttgttgtaggtggagagcagagagaggagaaaccagcaccgtccatattttattactgctgcaatcttctcggagtacaacctggggactgtgtgatggtcggtgacacattagaaaccgacatccaaggaggcctcaatgcaggattgaaagcaacagtctggatcaataaaaatggaatagtgccactgaagtcctccccagttccgcattacatggtttcttctgtgctagagttacctgctctcttacaaagtatagactgcaaagtcagtatgtccacttaaagcacataaaagggcatgattatgaatgttagaatcaatttgctgagtatgaaataagaaaagttagggcactccacttatgataatccagctctaagaataattttacttatgatttaatggccaatattttgaaggtcttcccaaccctattgcttctaagttgtaacaaccaaccattgagtggtacttatatctgaaaattcagattgcatgaattcaggtcagtagtatagcccagaaaatttaaggaaatatattatttgttagtctgtatctggagctttttaaaattatgttattaatcttttagtatcttggctgcataatgccaagcaggattgctttacacatggatgcacaaatgtaaggtttatcttctggcttaaaaatagatatttttaaaaaatagattttctaaaacacagatttatgaaagcaagtgaatctggttaatatgaaataagtactaagtcacatgcaaatcaaggtattatatagtgaaattattttgcatattttgaaaacataaaccatagtttttgcctactttggatgtatactttcttttatgaacctgatttttctgtatgacatttttttttttttcagagggcagggagcaatttttctatggcatgtgacagattcctccagttagaaaaagctgttaaaatcaacacatggtgctcctttaccgtgacattttctcacctgtgcacagtgagccggtagcttccttttagtcttcacctctcaaggaaatgtttttactgtcttttcccagacacacagtggggttgagggagctaggctgttttgctagagataattgcaaggcacgtggcactaaaagtcatttttcttctgtggatccataagaggaacatttcctcagtgtagcctaacaatgcagcccccaatctgttcctttttttttttgaaatgggatctctgtcgcccaggttggagtgccatggcaccatctcggctcactgcaacctctgcctcctgagctcaagtgatcctcccacctcagcctcccaagggtgtgtgtgactacaagtacacactaccacgcccagctaatgtgtgtttttgtagagatgggattttgccatgttgcccaggctggtctcgaattcctggattcaagtgatcctcccacctcagcctcctaaagtcctaggattataggcatgagccactgtgcctggccccctcatctgatagaaaattagattttgctatgagccatttcctgagggccaatttaatactcgtgtgactcttcttagagttaccatctgccttaaatttcctctgtttttcacattcttggaaatatatcattgttttgcaaatttctatatctaattcagggtttaccaggagcttaataattaatggctacatagcaaggcatcgtcttggaaccggagaattttctctagactattaggctagacagtctcatgattatactaaccaaacctggagtaaagtggttgaaaaaaaagaaagtataaaggggcttattaaagtggttaataaatatgatttaggttggtttttgatatgtttttcttccaactgttatataagaaactactaatgtaaaatagtaggctatatgttgggatgtgtatagctatgtcttcaagactaatactcagagaatcaaattgtagattgtacctatctgtgagcctatttctttagccagttttctgtctactgccaagaaacagaattctctgcctcatgcaaatgccctttcgtgtttacttttcgctctagatttttaaaaatgtgattgtgcccttgactgtaccaaagtgctgttgctataacagtgaacatttgtgaacagaggatgtttgtagtttcaaatgcagtacccatatgaccttgatcatattttagctatttaaaaattaagttggaggattttggcagaagtagtcacatgcatgattgctctgatagattggttggcgtgtgctgcagggggcttgtccttttaactctcccacaggatggatgtaggcagtgtcacattcattatgctgagagtgaaggttcatcactcctgtatcatggtagcaaatctcaacaggatagcttctaggatgttaagtgagcagttctccagcagaaatgatgtagaaggaaaaaattgaataattaaatttccttgtcttcacagtttgtattctacagagtacagtaatgtattacattccatttgcacccttccttagggaagaactttgtggttatctaccttctgagtggaatgttacagaaaatattttaaaatattggaataaacctatgattttattaatattttttgttttagaataatattccttaaaattatgggtgatgttttgtcatctttattttttttcaaagtttccctgtagtggccttctcacacaaagccagaggccctccctaacactgcttacagaggtgggcctagaacagacatgaatggacactgcacctggaataccagcacctggtggggaggtttggttccatgtgcacctccacatacaaggcacgaacatctcagatctgggagtgcccaggacccagtggatgctcagtattgtaggaaagcaggtctttaccaaagttcttggtttattgctttcaaacttctttgcaaccttcagtaagaaacattttctatcataacctctttaacacatttatagtgttagataacactgtaactatatataaatataaatataacacatgtatataaataaatataaatataacattttatagtataacattaatatgtgtatgggatccagttttatatgtttaattttcataaaacattcttgttacgtgtgatgatatttttcattccattcttttttgaattagggaatatattcattgttgaacaagtactacttgtagtacacaagtcaaaaaaataaaagggtgaatggtgaaaa

SEQ ID NO: 157318 - DNA, 1170 bp, Homo sapiens
  Payload ID: 10835
  Gene Symbol: NANS
  Gene Name: N-acetylneuraminic acid synthase
  Uniprot ID: Q9NR45
  ENST ID: ENST00000210444
  CDS Start-End: 71-1150
agagtagaggcggcggcggcggcggccggacccagactggtagtgaggctttggaccccgagccgctgcaatgccgctggagctggagctgtgtcccgggcgctgggtgggcgggcaacacccgtgcttcatcattgccgagatcggccagaaccaccagggcgacctggacgtagccaagcgcatgatccgcatggccaaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaaaaataaagtgccattctctg

SEQ ID NO: 157319 - DNA, 715 bp, Homo sapiens
  Payload ID: 10835
  Gene Symbol: NANS
  Gene Name: N-acetylneuraminic acid synthase
  ENST ID: ENST00000415280
  CDS Start-End: 296-715
tttttctacttgtatgttattccttgcctgtcataacaacagtgtttttggacaatggtgaaaaggagctccctctttgatttttgtagatggcagttgaattcctgcatgaactgaatgttccatttttcaaagttggatctggagacactaataattttccttatctggaaaagacagccaaaaaaggggctggcacagtgttttaagagatgtctgtggagttcagttgaatgatgagaccagcagttgggatgtgttggggagagtcagaacctctaaagagaaagtgctgatggtgttggtgctggattactcaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctg

SEQ ID NO: 157320 - DNA, 1378 bp, Homo sapiens
  Payload ID: 10835
  Gene Symbol: NANS
  Gene Name: N-acetylneuraminic acid synthase
  ENST ID: ENST00000427646
  CDS Start-End: 1-348
gaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaaggtgtgtcctgccggactctactcggttctgctgccgtgtgtggaaaaaggataggctggcctgagagggatggtcaggaccagccctccctgagccaggctgatgaaatgatcagtgaatgtgctcccacccgtgtcagcttcttcaggcttctcttcagtaatgcatgtcactctggcctgtagcagcagcaggagacacatgttatctaactttagcagtttctctggccacctagggtcacattagagtcttccactaattctctgaagcccatggccccagtactcctagactccagaatatgtaacaggagtgaggccctggaataagtcaagtctgggctcccttggagcaggtaagccctgagaaacatttaggcacggtgttccctgaggtaccagaagagcctgtggcatttcctaagccagggtggcactggtgggaagggcagtgagtcgttgcagaggtgggtgggtgatgatgcagctattccttgtgcaacagtgaccttcagacagaggaactggtgggcctagaagcactgcctggcatgctgactatcagggcttcctggaagccgtggcctggaccttcttgccttctgagtcatagagccaggcaggcatcctggggctgccaggcacacacacacctaacctgtaggctgtcggggtcaaggcaaagaccaaacaccaggcatgcctgggactgttgtcaccttttattctagtggggcctacctgcttccccaaatcaaagatgcatctataccaggaaattaaaataaagtaaaaagaaatagtttctttatagaggaaacaggagagaattagaccagaaaccagagtaagatttataacagctgagcacttaatttggctctctgagcagacagtaaaacataacaggatgcatgattatcacttgacattttttcctggcaccacattccaagcagaattgattccttgtactcttacgtggaggatatagagtaataaaacacgtaatttatttgaaagcatttatagagaagacaaacactggtcatgagcttcaggtacccttcattccctcatct

SEQ ID NO: 157321 - DNA, 1815 bp, Homo sapiens
  Payload ID: 10836
  Gene Symbol: NAT1
  Gene Name: N-acetyltransferase 1 (arylamine N-acetyltransferase)
  Uniprot ID: P18440
  ENST ID: ENST00000307719
  CDS Start-End: 174-1046
ctttggaagtgagagcacttcctcatagaccttggatgtgggaggattgcattcagtctagttcctggttgccggctgaaataacctgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccca

SEQ ID NO: 157322 - DNA, 2162 bp, Homo sapiens
  Payload ID: 10836
  Gene Symbol: NAT1
  Gene Name: N-acetyltransferase 1 (arylamine N-acetyltransferase)
  Uniprot ID: P18440
  ENST ID: ENST00000518029
  CDS Start-End: 521-1393
gtgggaggattgcattcagtctagttcctggttgccggctgaaataacctgctctccaaaatgtccacaaaagtgacttaagtcaggttcccccaaaccagacaccaagacaagaatccatgtgtgtgtgactgaaggaagtgctgggagagccccagctgcagcctggatgtgaactgcaactccaaagtgtgtccagactcaaggcaagggcactaggctttccagacctcctactaagtcattgatccagcactgccctgccaggacataaatccctggcacctcttgctctctgcaaaggagggcaaagcagcttcaggagcccttgggagtcctccaaagagagtctagggtacaggtccgaaagtagaagaacacagaaggcaggccaggggcactgtgagatggtaaaagagatctgaagggatccagaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccca

SEQ ID NO: 157323 - DNA, 1446 bp, Homo sapiens
  Payload ID: 10836
  Gene Symbol: NAT1
  Gene Name: N-acetyltransferase 1 (arylamine N-acetyltransferase)
  Uniprot ID: P18440
  ENST ID: ENST00000520546
  CDS Start-End: 272-1144
gctgtttatcatttgactcatcatttaatcttgatttccagcttctcacacttgaaagaagacataatacatttctcacaggattctgggactattaactgaacttatgtgtgtaaaaggaattcatacaatgaaagcactagaaataattattatacttataaccattgtatttttacatgtttaaaatatagccataattagcctactcaaatccaagtgtaaaagtaaaatgatttgctttcgttttgttttccttgcttaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattc

SEQ ID NO: 157324 - DNA, 2280 bp, Homo sapiens
  Payload ID: 10836
  Gene Symbol: NAT1
  Gene Name: N-acetyltransferase 1 (arylamine N-acetyltransferase)
  Uniprot ID: P18440
  ENST ID: ENST00000517492
  CDS Start-End: 639-1511
caagtcacatagggataaatcacaatagttggtcaactgttgaatcttgatccttcaactaaacaatattcatgaactctgcagaaaaacaccagcattttgctcaacattcaggaccctctagaagttgcctcattctactctcctttcttacctttcttttacacagctctccaaaatgtccacaaaagtgacttaagtcaggttcccccaaaccagacaccaagacaagaatccatgtgtgtgtgactgaaggaagtgctgggagagccccagctgcagcctggatgtgaactgcaactccaaagtgtgtccagactcaaggcaagggcactaggctttccagacctcctactaagtcattgatccagcactgccctgccaggacataaatccctggcacctcttgctctctgcaaaggagggcaaagcagcttcaggagcccttgggagtcctccaaagagagtctagggtacaggtccgaaagtagaagaacacagaaggcaggccaggggcactgtgagatggtaaaagagatctgaagggatccagaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccca

SEQ ID NO: 157325 - DNA, 1948 bp, Homo sapiens
  Payload ID: 10836
  Gene Symbol: NAT1
  Gene Name: N-acetyltransferase 1 (arylamine N-acetyltransferase)
  Uniprot ID: P18440
  ENST ID: ENST00000541942
  CDS Start-End: 308-1180
acttcctcatagaccttggatgtgggaggattgcattcagtctagttcctggttgccggctgaaataacctgaccgagagcatcaccccctgaacatggacttgcagaattccacagaagagaggagactggcctagacagacagccccaggagctgagggcccaacaggctttctaccctggatgctgctcccatgccctgacatgaggcccactacaatgaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 157326 - DNA, 1827 bp, Homo sapiens
  Payload ID: 10836
  Gene Symbol: NAT1
  Gene Name: N-acetyltransferase 1 (arylamine N-acetyltransferase)
  ENST ID: ENST00000545197
  CDS Start-End: 1-1059
atgctgttattactcttacacaaggaggcagccctcgagccacagggtccagctgttggctataatagcctaccggtctctgatgatcaccatgtttctggaattcaagccaggaagaagcagcaatctgtcttctggattaaaactgaagatcaacctactttcaacttactaagaaaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattactttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccc

SEQ ID NO: 157327 - DNA, 4002 bp, Homo sapiens
  Payload ID: 10837
  Gene Symbol: NAT10
  Gene Name: N-acetyltransferase 10 (GCN5-related)
  Uniprot ID: Q9H0A0
  ENST ID: ENST00000257829
  CDS Start-End: 207-3284
aatgcgcttgcgcacgtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgtatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcccgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaagatc

SEQ ID NO: 157328 - DNA, 3436 bp, Homo sapiens
  Payload ID: 10837
  Gene Symbol: NAT10
  Gene Name: N-acetyltransferase 10 (GCN5-related)
  Uniprot ID: Q9H0A0
  ENST ID: ENST00000531159
  CDS Start-End: 193-3054
gtgctgtctaccagttcctgagagggacgcgtgccgcggagccaggcttactacgtgacccggacaccaggcatacgctaggggcagtcagctgtgccttctctttcggagttgttccgtgctcccacgtgcttccccttctccactggctgggatcccccgggctcggggcgcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgtatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcccgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggccgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctg

SEQ ID NO: 157329 - DNA, 561 bp, Homo sapiens
  Payload ID: 10837
  Gene Symbol: NAT10
  Gene Name: N-acetyltransferase 10 (GCN5-related)
  ENST ID: ENST00000529523
  CDS Start-End: 125-561
aagtagtgcctgtaactggggagtcggggtgaatgggtgggtgacaacagttgttttccgtggagcttgcccgcagtgcctggctgcaggtctgggcattatacttaggtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggct

SEQ ID NO: 157330 - DNA, 1600 bp, Homo sapiens
  Payload ID: 10837
  Gene Symbol: NAT10
  Gene Name: N-acetyltransferase 10 (GCN5-related)
  ENST ID: ENST00000527971
  CDS Start-End: 18-884
agtaataatttttcaccatgcatcggaaaaaggtggataaccgaatccggattctcattgagaatggagtagctgagcggcaaagatctctctttgttgtagttggggatcgaggaaaagatcaggtggtaatacttcatcacatgttatccaaagcaactgtgaaggctcggccttcagtgctgtggtgttataagaaagagctggggtttagcagtcaccggaagaaaagaatgcgacagctgcagaagaaaataaagaatggaacactgaacataaagcaggacgacccctttgaactcttcatagcagccacaaacattcgctactgctactacaacgagacccacaagatcctgggcaataccttcggcatgtgtgtgctgcaggattttgaagccttaactccaaacttgctggccaggactgtagaaacagtggaaggtggtgggctagtggtcatcctcctacggaccatgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctagaaaga

SEQ ID NO: 157331 - DNA, 3329 bp, Homo sapiens
  Payload ID: 10837
  Gene Symbol: NAT10
  Gene Name: N-acetyltransferase 10 (GCN5-related)
  ENST ID: ENST00000615292
  CDS Start-End: 1-2505
atgaactcactcaagcaattgtacacagtgactatggatgtgcattccaggtacagaactgaggcccatcaggatgtggtgggaagatttaatgaaaggtttattctgtctctggcctcttgtaagaagtgtctcgtcattgatgaccagctcaacatcctgcccatctcctcccacgttgccaccatggaggccctgcctccccagactccggatgagagtcttggtccttctgatctggagctgagggagttgaaggagagcttgcaggacacccagcctgtgggtgtgttggtggactgctgtaagactctagaccaggccaaagctgtcttgaaatttatcgagggcatctctgaaaagaccctgaggagtactgttgcactcacagctgctcgaggacggggaaaatctgcagccctgggattggcgattgctggggcggtggcatttgggtactccaatatctttgttacctccccaagccctgataacctccatactctgtttgaatttgtatttaaaggatttgatgctctgcaatatcaggaacatctggattatgagattatccagtctctaaatcctgaatttaacaaagcagtgatcagagtgaatgtatttcgagaacacaggcagactattcagtatatacatcctgcagatgctgtgaagctgggccaggctgaactagttgtgattgatgaagctgccgccatccccctccccttggtgaagagcctacttggcccctaccttgttttcatggcatccaccatcaatggctatgagggcactggccggtcactgtccctcaagctaattcagcagctccgtcaacagagcgcccagagccaggtcagcaccactgctgagaataagaccacgacgacagccagattggcatcagcgcggacactgtatgaggtttccctccaggagtcaatccgatacgcccctggggatgcagtggagaagtggctgaatgacttgctgtgcctggattgcctcaacatcactcggatagtctcaggctgccccttgcctgaagcttgtgaactgtactatgttaatagagataccctcttttgctaccacaaggcctctgaagttttcctccaacggcttatggccctctacgtggcttctcactacaagaactctcccaatgatctccagatgctctccgatgcacctgctcaccatctcttctgccttctgcctcccgtgccccccacccagaatgcccttccagaagtgcttgctgttatccaggtgtgccttgaaggggagatttctcgccagtccatcttgaacagtctgtctcgaggcaagaaggcttcaggggacctgattccatggacagtgtcagaacagttccaagatccagactttggtggtctgtctggtggaagggtcgttcgcattgctgttcacccagattatcaagggatgggctatggcagccgtgctctgcagctgctgcagatgtactatgaaggcaggtttccttgtctggaggaaaaggtccttgagacaccacaggaaattcacaccgtaagcagcgaggctgtcagcttgttggaagaggtcatcactccccggaaggacctgcctcctttactcctcaaattgaatgagaggcctgccgaacgcctggattacctgggtgtttcctatggcttgacccccaggctcctcaagttctggaaacgagctggatttgttcctgtttatctgagacagaccccgaatgacctgaccggagagcactcgtgcatcatgctgaagacgctcactgatgaggatgaggctgaccagggaggctggcttgcagccttctggaaagatttccgacggcggttcctagccttgctctcctaccagttcagtaccttctctccttccctggctctgaacatcattcagaacaggaacatggggaagccagcccagcctgccctgagccgggaggagctggaagcactcttcctcccctatgacctgaagcggctggagatgtattcacggaatatggtggactatcacctcatcatggacatgatcccggccatctctcgcatctatttcctgaaccagctgggggacctggccctgtctgcggctcagtcggctcttctcttggggattggcctgcagcataagtctgtggaccagctggaaaaggagattgagctgccctcgggccagttgatgggacttttcaaccggatcatccgcaaagttgtgaagctatttaatgaagttcaggaaaaggccattgaggagcagatggtggcagcgaaggatgtggtcatggagcccacgatgaagaccctcagtgacgacctagatgaagcagcaaaggaatttcaggagaaacacaagaaggaagtagggaagctgaagagcatggacctctctgaatacataatccgtggggacgatgaagagtggaatgaagttttgaacaaagctgggcgaacgcctcgatcatcagcctgaaaagtgacaagaaaaggaagttagaggccaaacaagaacccaaacagagcaagaagttgaagaacagagagacaaagaacaaaaaagatatgaaactgaagcggaagaaatagtgaagagaaactcgggcatctgtgtttgatcatgggaagatactctcactaactgaaccctctctggctggactgttaaaagcaacgagaggccccggcacacctggaagctggccgcgaattcggcctctgggcctgtgtgtctgtgagctcaacctggctaaaggcagagtcactcccaaatgggtctctttagaacttgatggctgggcactgccatctctagaattgccacgagtctctctcttcctgcccagtccagggccctcctttcctataagttcatattttgctttgagccagctttttagtctcattcccacacatgtggaagccacgttgcctctcgaccgcctgaggcccttaagtacatcgctttctggtggtgcccaggaggctgctgctgggccgctgggtctctctttgtggacttgtacctggagcaggaggaactccagtccgtcccggcatccatggcagcccgcggttaggtgcgccagggtttgctgatgttgtcttgtgctgttccactcttggctccagcagacccactgtcccagaaaagcctgatcctgtagtttatgtagaatgccacatctgcgtcctcaagacctgtttcatccatttgggaaaagatgttgggaaaggccactttgctcgcaggggtgaggggaaggatagagaatctatttttaataaataacattctag

SEQ ID NO: 157332 - DNA, 1536 bp, Homo sapiens
  Payload ID: 10838
  Gene Symbol: NAT14
  Gene Name: N-acetyltransferase 14 (GCN5-related, putative)
  Uniprot ID: Q8WUY8
  ENST ID: ENST00000205194
  CDS Start-End: 304-924
gctcccgttcttccccaggtcccctttccccgttgctccttctctagggataggagaggtcgcttcccggccctccgcagggtcacagctcggttcctcccagcccgccctccggggagcttagcaacggttgctacggcccggagcgggcgccgccccgccccaccgcgcgcggtctgacgtcacttccgcccgcgacccccttccagacccgctcccgaaaccttgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctggggggtgggagggatgctggagggctgtggctaccaggccgaggggggctggggctgcctgggctacacgctggtgagggaattcagcaaagacctgtgaagctacagactgacagccagggcaggggaggagggaggggcgccagcacctgatgatcgcctactgtctgcgggttcttttacctgctctccctcagtgagtcctcaaccaccctgggcccagaaacagaggcctgccgaggggaggagcctggcctctgtccacccgtcagcagtgtgaagtctgttgtgtttgagcttctcagagtggaatgactccttttccttcctggccctcgggggcctctcgaggtcagcctctccaacccctacctcagctcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgctg

SEQ ID NO: 157333 - DNA, 1011 bp, Homo sapiens
  Payload ID: 10838
  Gene Symbol: NAT14
  Gene Name: N-acetyltransferase 14 (GCN5-related, putative)
  ENST ID: ENST00000591590
  CDS Start-End: 113-271
cccgcgacccccttccagacccgctcccgaaaccttgtcgaaggaccaaaggcgaccggtgcaggtgcacgacgccagctcccttctggggggccggggcctgggggttgccatggcccccagccacctgtcagtgcgggagatgagggaagatgagaagcccctggtgctggagatgctgaaggtgagaggcaggggccccagggggcctgggagtggctgcagtgggggaattgcaagtggattcagccaccccctcccacccacctgagccagcctggacccctggagcgggatcttttcctcctgagcctcagccgccctgctgctgaaaaccacagcaggtgtggcaggtgggggctcacccccccagccctactgggaccccagcaccaacgccctccctggtctcccatctccagtcggctgtgcacgccagcacaacagccagctctgtgcctcggaccccaactcttcaaagcacagcccagcaccccaacctagcccagcagcctccctccagcctccactccagcctgaggcaacctccctgtccttacttccctggggcctcactgcggcattgctactgaattgagtgcccccacagctcctaattcactcatccatccatcattcgctctcgttcattcattcactccatacccagtgtgccacactgaacatcggactgtgctgccttcccttcccatttgggagctctcaccccgccccgggcagggtctacctcctctctttgtccaggaggccctagcgtttcggatggctgagccacccctcctgcccacaggccggcgtgaaggacacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgcc

SEQ ID NO: 157334 - DNA, 730 bp, Homo sapiens
  Payload ID: 10838
  Gene Symbol: NAT14
  Gene Name: N-acetyltransferase 14 (GCN5-related, putative)
  ENST ID: ENST00000588985
  CDS Start-End: 1-520
cacggaaaaccgcgtggccctccatgccttgacacggccgccggccctgctcctcctggcggcggccagcagcggcctgcgctttgtcctggcttccttcgccctggccctcctcctgccggtgttcctggctgtggccgccgtgaagctgggcctgcgggcccgatggggctcgctgcctccgccgggtggcctggggggcccctgggtggccgtgcggggctccggtgacgtgtgtggggtcctggctctggcccctggcacaaatgcaggggacggggcccgggtcacccgcctgtctgtctctcgctggcaccgccgccggggcgtgggcaggaggctgctggccttcgcggaggcccgggctcgggcctgggctgggggcatgggggagccccgggcccggctcgtggtccccgtggctgtggccgcctgggggtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgctg

SEQ ID NO: 157335 - DNA, 416 bp, Homo sapiens
  Payload ID: 10838
  Gene Symbol: NAT14
  Gene Name: N-acetyltransferase 14 (GCN5-related, putative)
  ENST ID: ENST00000587400
  CDS Start-End: 74-208
gaaggaccaaaggcgaccggtgcaggtgcacgacgccagctcccttctggggggccggggcctgggggttgccatggcccccactcctgtctgcactgagaaacctccccgggtgatgtctgcaaagtctgtgctgtccgtgccccaggctgggagagctatctggggagggggagaggaggccgagcagaatacaccccagagttagggtttgcgactccgcctccctgggacctggattgggtcagatgcctgtccttggaggggacaaggttgactgcttaggaggcgcgacgcacagggctgccaggcctggcccctctctgggaaggttgagagctgagacgggcagccctgtcccttcctccagatccgtctggttttttacaccgtttgttaataaagcctgaaaccgc

SEQ ID NO: 157336 - DNA, 2935 bp, Homo sapiens
  Payload ID: 10839
  Gene Symbol: NAT16
  Gene Name: N-acetyltransferase 16 (GCN5-related, putative)
  Uniprot ID: Q8N8M0
  ENST ID: ENST00000300303
  CDS Start-End: 240-1349
gaaccgatgggcgccccggcccgcgtcgccaacggagctgcggcgctgccccagcgctgaccgacgttagagtcgggctccgacagcgcggccgagtccccgcgcgtcatcctcctttgactcttgggggctccaaagggacctctctcttggcaccgggggtgtctgcgcccgccgcccgccccgcttggctttgcggcatctcggccctggctccagctccggctccggcgagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtgatcgcgctggagtcggtgaacgtgatcgacgccggggagacggtgctggtggaggggctgcgcgtggcgccctgggagcgcgggaagggcgtggccgggctgctgcagcgcttctgctcgcagctggtcaagagacagcacccgggggtcaaggtggcacggctcacccgggacgaccagctgggcccccgggagctgaagaaataccgcctaatcaccaagcagggcatccttttggtccgattcaacgcgtccgcgctgctggccgggctgggcgcgcggctggcggcgctgcggacctctggcaccttctcgccgctgcccaccgaggccgtgtccgaggcaggcggcgacgtggcacgcctcctgctgtcaccctccgtgcagcgcgacgtgcttccaggcgggaccatcatccaggactggcagccctaccggcctagcgaaagcaacctgcgcctgctggcggccaagggcctggagtggcgcgtggacagccgcgcgcgcccgcgcgtgctcacgctgtgcacgcgccccttccccatcccgcacggaggggacggcacttggcgctatctcaacatcgacgccttcggtagcgacggcgcgcaggtgcagagccagctgctgtggcacctgcagcgccaggccccgcgcctcgttggcctcaacgtcatgtgccagctcttcctggagccccagctgtggtcacagctggctgacttctgccaggtcgggctgggactggagctggtgaagggttatactgaacagtacctgctggaggccgacatctgaggcctctcctctggcggggagggggaaaaagacccgcccccttccgcagtttccccagccagcctctttcctgccatttccgacgctgcgtctcctgggaagtcccctctgactcctgccctcctgcccttaccggcgcaggtccccccactctgtcccttttgcccttactatcttgcctctagctcccccaaacaccattgcccactccctgacctgaacttgcggactattaggtgggggctgggggtgggggccttgagctgctgttatccaccctctgtttttccaaagaactggtccccgcacaggcttcagagtccttccttccctctccatcacctcacccggggcgtgaactccccctttcctggcttctcccttctgccccctcgtgggtggaagaactcaggagtgtgtgggatgcccagcctcgttcccgagcgcagccgcccaatccgcgtttcttttcttccttctgccctttctaaagccctaaaaactggtcctgcattgccctccacaccccaatcccctccccctgctcaagcttctggtgccagagatcagtgccctctccccacttctctctagcccctcatcctcatcctcgctggatctctacgacgcttaacaccgcagtgcccatttttctgtccctgttttccttcccatcaccagcccagtgtgcaatccagagagagagagagtgatactgtaaaatgaaatgtatttagaatgctcccccatttgggtccttgttcatctggtgatgcactttctgagcctgcctctctcactggggtttcctcctgctttgcacaactttgctatttcgcaggctcccccgtgccccagctcacccgagccgggcggggtggtggtggtggtggtggtgtgtgtgtggtgtggttctagctgaagagtttggtacagtggagggcgggtccctcagcctggcataggggctgtctcctggttccaaccaggccgccttctagtgcaactggaattcccacctcctggtatttctggacaccactccctttctctggatcatttatgcttttagaactttgagagtcttctatttaattgcaagtagtaacagctgcatctgcacagcgctgtctccaatactggttccccacatcaaaggcagagggagaaaacagaaggctgggaaagatcaaagtgacttctaagtcattcaaagtagctaggagcctcccagcgaatagaacccgggtgtcccaagcctagagcatgacctagaacttcactctgtgggatgatgttagcttgaacttcttgttgggcaatgcgtaggtgctaggagaatgttgacagtgagtttggggttcgctgggatgggatccgagatgtgggcagaggtggacaccagcaggtggaagaatgtggacaaggtggggggtaggggcagccgccgcttcgccactttccgcagctctggttttgctactgtgctgctctccttgggtgcatcctgtgcctggccacgctgccaccctccttgtcacggtgaccacgattgtatgacaataaaatggaccttttggccaccc

SEQ ID NO: 157337 - DNA, 613 bp, Homo sapiens
  Payload ID: 10839
  Gene Symbol: NAT16
  Gene Name: N-acetyltransferase 16 (GCN5-related, putative)
  ENST ID: ENST00000444446
  CDS Start-End: 145-613
ttttcgctctcatctttgggcgctttgtgcagctgccttctttgtctccgcctctccggcgactgggctctcccttccctccctctcctccctcccccagtgtcaagaagccatcggcctcaagggcatcgatatttcagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtgatcgcgctggagtcggtgaacgtgatcgacgccggggagacggtgctggtggaggggctgcgcgtggcgccctgggagcgcgggaagggcgtggccgggctgctgcagcgcttctgctcgcagctggtcaagagacagcacccgggggtcaaggtgg

SEQ ID NO: 157338 - DNA, 1286 bp, Homo sapiens
  Payload ID: 10839
  Gene Symbol: NAT16
  Gene Name: N-acetyltransferase 16 (GCN5-related, putative)
  Uniprot ID: Q8N8M0
  ENST ID: ENST00000443096
  CDS Start-End: 179-517
cgacgttagagtcgggctccgacagcgcggccgagtccccgcgcgtcatcctcctttgactcttgggggctccaaagggacctctctcttggcaccgggggtgtctgcgcccgccgcccgccccgcttggctttgcggcatctcggccctggctccagctccggctccggcgagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtggtgagcccgggggcacggcccaggtgacatggggtgaagccacctgcgggtgcgtggatcttaggaagaggaggatgagagcttctccccagccttcctctggaggctgcggaaatagagcctgctttgggaccaaagtgcagggcgtgcagtgcggatccaggggctatgtcagtgagggtggggtggaggactcctaaagcagaggaaccagagggacaggtgagcgtttgaaagttcgaggatccaccggaggaatttctgggggtaaaagcaaaggaggtggggagcaggagagagagggtaggctaggggtgggagcaggaagagcttagatttgggctgggggaggagctaagaggaagtggggcgtggcaaactcccgggggaggagccaaggaaggggcgtggtgagcggtccggaacttgacacactcggagctggagcatctcaagaggtggaaggggccgggcgcgtcggctaactcctgtaaccccagctctttgggaggccgaggcaggaggatcacttgaggctaggagttccagaccagcctgggcaacatgcgagacccctgtctccaaaaaataaaaataaataaaaagccgagagtaggggtgcgtgcctgttgtcccagctactaggaagtcttgggggtgtaggggatcgcttgagcccaggagtttgaggctgcagtgagctgtgatagcaccactgcgctccagcctgggtgaggagaccctgtcctaaatttaaaataaataaaaataaaaaggtggacgaagccccggcgaa

SEQ ID NO: 157339 - DNA, 1492 bp, Homo sapiens
  Payload ID: 10839
  Gene Symbol: NAT16
  Gene Name: N-acetyltransferase 16 (GCN5-related, putative)
  Uniprot ID: Q8N8M0
  ENST ID: ENST00000455377
  CDS Start-End: 219-1328
cgacgttagagtcgggctccgacagcgcggccgagtccccgcgcgtcatcctcctttgactcttgggggctccaaagggacctctctcttggcaccgggggtgtctgcgcccgccgcccgccccgcttggctttgcggcatctcggccctggctccagctccggctccggcgagtgtcaagaagccatcggcctcaagggcatcgatatttcagggtcatgaagctggaagccagctgtggcacagccacctcagaggtccctaagccggaaaagaagactgcccgagatgcagagccaagctctgaaacccggccacaggaggtggaggccgagcccaggtcgggatcggggcctgaggctgaggccgagccattggacttcgtggtggccacggaacgggagtttgaggaagtgctggccatctcggggggcatctacggcggcctggactaccttcctagccgctaccacagctggctccgggaccccgaccgcacggtggtgctggccaagcgcaacggaggcgtgatcgcgctggagtcggtgaacgtgatcgacgccggggagacggtgctggtggaggggctgcgcgtggcgccctgggagcgcgggaagggcgtggccgggctgctgcagcgcttctgctcgcagctggtcaagagacagcacccgggggtcaaggtggcacggctcacccgggacgaccagctgggcccccgggagctgaagaaataccgcctaatcaccaagcagggcatccttttggtccgattcaacgcgtccgcgctgctggccgggctgggcgcgcggctggcggcgctgcggacctctggcaccttctcgccgctgcccaccgaggccgtgtccgaggcaggcggcgacgtggcacgcctcctgctgtcaccctccgtgcagcgcgacgtgcttccaggcgggaccatcatccaggactggcagccctaccggcctagcgaaagcaacctgcgcctgctggcggccaagggcctggagtggcgcgtggacagccgcgcgcgcccgcgcgtgctcacgctgtgcacgcgccccttccccatcccgcacggaggggacggcacttggcgctatctcaacatcgacgccttcggtagcgacggcgcgcaggtgcagagccagctgctgtggcacctgcagcgccaggccccgcgcctcgttggcctcaacgtcatgtgccagctcttcctggagccccagctgtggtcacagctggctgacttctgccaggtcgggctgggactggagctggtgaagggttatactgaacagtacctgctggaggccgacatctgaggcctctcctctggcggggagggggaaaaagacccgcccccttccgcagtttccccagccagcctctttcctgccatttccgacgctgcgtctcctgggaagtcccctctgactcctgccctcctgcccttaccggcgcaggtccccccactctgtcccttttg

SEQ ID NO: 157340 - DNA, 1322 bp, Homo sapiens
  Payload ID: 10840
  Gene Symbol: NAT2
  Gene Name: N-acetyltransferase 2 (arylamine N-acetyltransferase)
  Uniprot ID: P11245
  ENST ID: ENST00000286479
  CDS Start-End: 108-980
tgagatcacttcccttgcagactttggaagggagagcactttattacagaccttggaagcaagaggattgcattcagcctagttcctggttgctggccaaagggatcatggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgagaaatatatttaagatttccttggggagaaatctcgtgcccaaacctggtgatggatcccttactatttagaataaggaacaaaataaacccttgtgtatgtatcacccaactcactaattatcaacttatgtgctatcagatatcctctctaccctcacgttattttgaagaaaatcctaaacatcaaatactttcatccataaaaatgtcagcatttattaaaaaacaataactttttaaagaaacataaggacacattttcaaattaataaaaataaaggcattttaaggatggcctgtgattatcttgggaagcagagtgattcatgctagaaaacatttaatattgatttattgttgaattcatagtaaatttttactggtaaatgaataaagaatattgtggaaaaa

SEQ ID NO: 157341 - DNA, 716 bp, Homo sapiens
  Payload ID: 10840
  Gene Symbol: NAT2
  Gene Name: N-acetyltransferase 2 (arylamine N-acetyltransferase)
  ENST ID: ENST00000520116
  CDS Start-End: 117-599
attacagaccttggaagcaagaggattgcattcagcctagttcctggttgctggccaaagtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgagaaatatatttaagatttccttggggagaaatctcgtgcccaaacctggtgatggatcccttactatttagaataaggaacaaaataaacccttgtgtatgtatcacccaactcactaattatcaacttatgtgctatcagatatcctctctaccctcacgttattttgaagaaaatcctaaacatca

SEQ ID NO: 157342 - DNA, 1330 bp, Homo sapiens
  Payload ID: 10841
  Gene Symbol: NAT6
  Gene Name: N-acetyltransferase 6 (GCN5-related)
  Uniprot ID: Q93015
  ENST ID: ENST00000354862
  CDS Start-End: 203-1129
aggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttgggta

SEQ ID NO: 157343 - DNA, 765 bp, Homo sapiens
  Payload ID: 10841
  Gene Symbol: NAT6
  Gene Name: N-acetyltransferase 6 (GCN5-related)
  ENST ID: ENST00000450489
  CDS Start-End: 507-765
agtcgttcgtttccagaccatgccgagccacacctgcccacagagtcgagctctcgaagtcctcattcccaaaagctccacagcctgtgacccactaggagggagggggaaaccgaggcccgggagagacggagaagccactctctgaggaccccggagccccgcccacagtgggtggggtcggcactgaaggggttaaggccgcggggaagccccgggctcagccctaggggcggatcctggggcttcctccctctagaccaaagggtgcggctgctgcagaggtggctgatgcaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagcc

SEQ ID NO: 157344 - DNA, 860 bp, Homo sapiens
  Payload ID: 10841
  Gene Symbol: NAT6
  Gene Name: N-acetyltransferase 6 (GCN5-related)
  ENST ID: ENST00000442620
  CDS Start-End: 690-860
aggggcggatcctggggcttcctccctctagaccaaagggtgcggctgctgcagaggtggctgatgcagtggtggactaggaggactactggaagacagaaggccagcaagtagattgggtcggctgttttatagacctggtggttacagaccccctgtgaggggaggtcctgaggaggacaaatttgtagccagagcaggctggggccaggactcctaggttctgccccagccttaagcagctcatccatcactcccagcctccctccaatgtggggtagacacctggatctatctgccctgctctataggggatgggtctcttccaggtcacctgtgctatcaggtgagtgtgggacaaagtgcagcccaccactccccagttccagtatgcatggtcccccctgcactctgtcagcccttccctgctccaaccccaccctccctcctggcacagcccagcatggctgttatctacaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctg

SEQ ID NO: 157345 - DNA, 1163 bp, Homo sapiens
  Payload ID: 10841
  Gene Symbol: NAT6
  Gene Name: N-acetyltransferase 6 (GCN5-related)
  Uniprot ID: Q93015
  ENST ID: ENST00000417393
  CDS Start-End: 104-964
gaccaaagggtgcggctgctgcagaggtggctgatgcaggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaataaaggctctcttggg

SEQ ID NO: 157346 - DNA, 1820 bp, Homo sapiens
  Payload ID: 10841
  Gene Symbol: NAT6
  Gene Name: N-acetyltransferase 6 (GCN5-related)
  Uniprot ID: Q93015
  ENST ID: ENST00000443842
  CDS Start-End: 809-1669
cggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacattggtggactaggaggactactggaagacagaaggccagcaagtagattgggtcggctgttttatagacctggtggttacagaccccctgtgaggggaggtcctgaggaggacaaatttgtagccagagcaggctggggccaggactcctaggttctgccccagccttaagcagctcatccatcactcccagcctccctccaatgtggggtagacacctggatctatctgccctgctctataggggatgggtctcttccaggtcacctgtgctatcaggtgagtgtgggacaaagtgcagcccaccactccccagttccagtatgcatggtcccccctgcactctgtcagcccttccctgctccaaccccaccctccctcctggcacagcccagcatggctgttatctacaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggt

SEQ ID NO: 157347 - DNA, 1464 bp, Homo sapiens
  Payload ID: 10841
  Gene Symbol: NAT6
  Gene Name: N-acetyltransferase 6 (GCN5-related)
  Uniprot ID: Q93015
  ENST ID: ENST00000443094
  CDS Start-End: 419-1279
aaaccaggggcgggttctaagcggcgacgcgcgggtgctgggaggccttagaacgccgtggcgtgccgcaggacgcgacggctgcagaacatccgccgcaccgctgggggccaacgttgtcggaccgaggagtccgaggtggcgactgagtgagatacccagctgtgcggagctaggacgcggaacatcccagaggccagcatcaacatgaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccagctgagctgactctggatcctgcgtgccagccaaagctgcccctggattccacatgccaaccagagatgaccttcaatcctggtccaactgagcttaccctggatcctgaacaccagccagaggagaccccagctcctagcctggctgagttgaccctggagcctgtgcaccgccgacccgagctcctggatgcttgtgctgacctcatcaatgatcagtggccccgcagccgcacctcccgcctgcactccctgggccagtcctcagatgccttccccctctgcctgatgctgctaagcccccaccccacacttgaagcagcacccgttgtggtgggccatgcccgcctgtcacgggtgctgaaccagccccagagcctcttagtggagacagtggtggtggcccgggccctgaggggccgtggctttggccgccgcctcatggagggcctggaggtctttgctcgggcccggggcttccgcaagctgcatctcaccacccatgaccaggtgcacttctatacccacctgggctaccagctgggtgagcctgtgcagggcctggtcttcaccagcagacggctgcctgccaccctgcttaatgccttccccacagccccctctccccggccacccaggaaggccccaaacctgactgcccaagctgccccaaggggtcccaagggacctccattgccaccaccccctcccctacctgagtgcctgaccatctcacccccagttccatcagggcccccttcaaaaagcctgctggagacacaatatcaaaatgtgagggggcgccccatattctggatggaaaaagacatctgaggccatccagggcaaggaactgtctttctggttcaatagactgccccgacagtctacaagcctcagcccactgaccatacctcagcccctagcccctggggggcagctttaacctgggcatgtttcctgggtaccagtggggccaggaggtggctctggctcagagccgtcagtgtggctgaata

SEQ ID NO: 157348 - DNA, 583 bp, Homo sapiens
  Payload ID: 10841
  Gene Symbol: NAT6
  Gene Name: N-acetyltransferase 6 (GCN5-related)
  ENST ID: ENST00000452674
  CDS Start-End: 556-583
aggggcggatcctggggcttcctccctctagaccaaagggtgcggctgctgcagaggtggctgatgcagtggtggactaggaggactactggaagacagaaggccagcaagtagattgggtcggctgttttatagacctggtggttacagaccccctgtgaggggaggtcctgaggaggacaaatttgtagccagagcaggctggggccaggactcctaggttctgccccagccttaagcagctcatccatcactcccagcctccctccaatgtggggtagacacctggatctatctgccctgctctataggggatgggtctcttccaggtcacctgtgctatcaggaggagagccactgtggtctgaagagatgctactgcctggagactggggtcttaacctccagcctggcactgagccacctgcaacctagcagcaggtgaccttggctcccagcctgactcagctgaacctggatcctgtgcataggcaagagctgactctgagccctggcccagccaagctgacccctacactagaccctacacaccggatggagctgatcctgagtaccagcccag

SEQ ID NO: 157349 - DNA, 947 bp, Homo sapiens
  Payload ID: 10842
  Gene Symbol: NAT8
  Gene Name: N-acetyltransferase 8 (GCN5-related, putative)
  Uniprot ID: Q9UHE5
  ENST ID: ENST00000272425
  CDS Start-End: 151-834
agacggtatctcctggatgccagtgagcggctgagagctgaagctccctggacactcaaggctcttgtggtgacagtctgacgtaaaggcgtgcagggaggcctagctctgtctcctggacttagagatttcagacacagaagtctgtccatggctccttgtcacatccgcaaataccaggagagcgaccgccagtgggttgtgggcttgctctcccgggggatggccgagcatgccccagccaccttccggcaattgctgaagctgcctcgaaccctcatactcttacttggggggcccctcgccctactcctggtctctggatcctggcttctagccctcgtgttcagcatcagcctcttccctgccctgtggttccttgccaaaaaaccctggacggagtatgtggacatgacattgtgcacagacatgtctgacattaccaaatcctacctgagtgagcgtggctcctgcttctgggtggctgagtctgaagagaaggtggtgggcatggtaggagctctgcctgttgatgatcccaccttgagggagaagcggttgcagctgtttcatctctttgtggacagtgagcaccgtcgtcaggggatagcaaaagccctggtcaggactgtcctccagtttgcccgggaccagggctacagtgaagttatcctggacaccggcaccatccagctctctgctatggccctctaccagagcatgggcttcaagaagacgggccagtccttcttctgtgtgtgggccaggctagtggctcttcatacagttcatttcatctaccacctcccttcttctaaggtagggagtctgtgatctctttctgtgtgtattggtcagaatagaatccattcagctgtagcagcaagcaatccccaacctttcactgcaatgacctttcaatgcaataaaagcttattgtccattca

SEQ ID NO: 157350 - DNA, 765 bp, Homo sapiens
  Payload ID: 10843
  Gene Symbol: NAT8B
  Gene Name: N-acetyltransferase 8B (GCN5-related, putative, gene/pseudogene)
  ENST ID: ENST00000377712
  CDS Start-End: 36-714
ctggactcagtgacttcagacacagaagtctgtccatggctccttatcacatccgcaaataccaggagagcgaccgcaagtaggtcgtgggcttgctctcccgggggatggccgaacacgccccagccaccttccggcgattactgaagctgcctcgaaccctcatactcttacttgggggggcccttgccctactcctggtctctggctcctggattctggccctcgtgttcagcctcagcctccttcctgccctgtggttccttgccaaaaaaccctggacgcggtatgtagacatagcattgcgcacagacatgtctgacatcaccaaatcctacctgagtgagtgtggctcctgcttctgggtgggtgaatctgaagagaaggtggtgggcacagtaggagctctgcccgttgatgatcccaccttgagggagaagcggttgcagctgtttcatctctctgtggacaatgagcaccgtggtcaggggatagcaaaagccctggtcaggactgtcctccagtttgcccgggactagggctacagtgaagttgtcctggacaccagcaacatccagctctctgccatgggcctctaccagagcttgggcttcaagaagacgggccagtccttcttccacgtgtgggccaggctggtggatcttcatacagttcatttcatctatcacctcccttctgctcaggcagggcgtctatgatttctttccttctgtattggtcagaatagaatccattcggctgtag

SEQ ID NO: 157351 - DNA, 5571 bp, Homo sapiens
  Payload ID: 10844
  Gene Symbol: NAT8L
  Gene Name: N-acetyltransferase 8-like (GCN5-related, putative)
  ENST ID: ENST00000331662
  CDS Start-End: 205-609
gagcgcatccctaacacggccttccgcggcctgcggcagcacccgcgcgcgcagctgctctacgccctgctggcggcgctgtgcttcgccgtgagccgctcgctgctgctgacgtgcctggtgccggccgcgctgctgggcctgcgctactactacagccgcaaggtgatccgcgcctacctggagtgcgcgctgcacacggacatggcggacatcgagcagtactacatgaagccgcccggctcctgcttctgggtggccgtgctggatggcaacgtggtgggcattgtggctgcacgggcccacgaggaggacaacacggtggagctgctgcggatgtctgtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccgcccgcccccccggccgccctgtccgcctttgcccgcctgcccgccgcccggcgcggcctgctttcagacgctcaattggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggccccagctggccacggcgctgctttgctccgcgcatgccgagggtgtggcccggctgagcatgccgcatgcacacagccccgccctgccgccctgcccagactggacccggagacccgggctggtgagcgcccctgtccccagcccccagctggctgtgggagggcctgcccctgcccccacctcctggagggcctggtctgccccgcgccgcccggctctgtccacacctgctttgctctgacgccctccatttctctggctccggcccctcccctgcctgggctgtgctgactggtgtcatcacccaggtgactcccatggcgtccgtggcacagccagggtgggggtccatgggacccctctccccagtgcccactggatcgtgctggcctctcccagatgtccccggggacctcctgcctctggctgacggtccaccctgtgaatcttatcagcccaggctgctgccaacagcgcccagcccacagcttctcccagcctgaaaccaacacattttctaataagttatttagacagaatagcactctgcatgactttaattcttgggacaaaacggtagtttgtaccctaagacacagtttctggcccagtgtgatgggggtgggtggccgggtgggtggagcgttttgctgttggaaacctggagggaaaccctgattggatgtcatttcctgccatggagcacgcctcccagccctggcctgcagtgtgggcagggtggggggcaagggagtccgcagcctccgggaggaggggcagggcgctgccttgggctgggtgggaagaggggtggccgcctcggcttccgctggccatgctcctggtctctccttcctgaggtcacaggcaggggctgccctggacggggggcggggggggtggcctggaaggggagacagaggtggagggtggcacaggctgcacattcagcttagaagtggacctggctttggtggcaggagaagaataaacacttgcccagacccctttgtgtgggggaattggggaggggtcgtggcaggcagggtgggccacggaactgggtcccaggcatcaaggccacgtgcagggccatggagggatgcttctcacgaggcgcttcagaagcgagcgaagggacagagaagccctgcgtccaagggccttttgtcctgttagcaattgaggtgtgcagagcactgtacagaccccactcccctgtacattcctccctggaggtgcccggtccccgcttggggatgggagttttgtagactgtacagaaatcggcaccctattttcttgcagctcagattttgttaatctggaatatacagacagacgtaaagtgttttagcaaaatggaaacaaacagttgtgcctttttcctcttttggtttggtttgggtttggcctggggctggtcccagttggtgcggggcatgctgggggcaggaggggcagggcgggccaggtggagtcaggtcttgggggtgtcatgtcggggtgctgccagcgtcccttggtcctgtgcctttggagcctcgggctcctggggtgcagggtgcttgggggtggctgttggagcccaccgacgccagggcagggcctggaggcccagggactgccagtgtctccttgatattgatcctagcagatccccctcctgggggttctgagagtcctgggcagtgtggccttctctcattctggtggcatctgcgcccgtgagtgacctcttccttggctgcactgccctgtgggtggtgagacgcttggccttttttgttgctgccaggacttggtagagatggcaggaagggtgtgcggggtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacatgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggccacccctctcctgctctgggtgtccttctcagagaagatggcagaaggctgcaggccctagaggggacgacgggctggggacgccctgagcttcctggctgtgtggcaggtgctggggaagctctctgggccatagggacctggctcccctctgagaggcccgcctgccctggggcacccagggctgtgctggtggcctgaggctgggaacttgggttcctgggctctgctggcgcctgggctttgtgggggccgaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccatggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtgcaagtgggttcttggatatgtgtagtgtgagcatgtgtgcatgtgtgagcctgtgcacgtgcatgttgtaggtgcataagcatgtacacgcgtgagcatgcatgtgtgtgtacacgtgtataggtgtacatgtgcatgagttgtgtacatgcgtgagcacgtgtatagatgtacgtgtgtgtgcgcatgtgtgcgtgtacatgtgtttgtgtcttgggtatgcataagcatgcacgtgtgtatgaatgtgcgtgtgtatgcatgagcacgtatgcatgtgtgatgcgcatgttcttgtgtacttctctgagggggcacatatgtatgagtgtatgagtgcatacatatgcatatggtgtacgtgtgtgtactttgtgtgtgggcatgtatgcgtatgagtacttgtgtgtggctggtgtatgggtgagcatgcacatgtgtatggatgcatatgtgagctgtacatgtagagtgtacatgtgtgttgcatgagcatgcatgcgtgcgagtgcctgtgtgtgtacttgcatatatgtggctgtgcaggtacccggcggtggtgggctggcagtgcccggggaagcaggtcctgctcacggcttccctgctgggccccaggccccgggctgagcctccctggcccctcttgcccctcagtggagcagggcctgggtggagggcctgggcagctccagggcaggtccggggaggccaggcttggggagcacagggggtggggttcacctgctgctgtttgttcccgaaactgtactgtgagcccacggcgggggcagattgttctgaggccccagatgtgccaaaacagcccccagggtgggggcgagcgagttctgaggagaggggctgcgggggccgggggtgggtgtgtgcccctcccctgaatggcccccaatgctgctgtttttcaataaaaccagagttgaaggca

SEQ ID NO: 157352 - DNA, 5870 bp, Homo sapiens
  Payload ID: 10844
  Gene Symbol: NAT8L
  Gene Name: N-acetyltransferase 8-like (GCN5-related, putative)
  Uniprot ID: Q8N9F0
  ENST ID: ENST00000423729
  CDS Start-End: 1-909
atgcattgtgggcctcccgacatggtctgcgagacgaagatcgtggccgccgaggaccatgaggcgctgccgggggccaagaaggacgcgctgctcgccgccgccggcgccatgtggcccccgctgcccgccgcgcccgggccggccgccgcgccccccgcgcccccacctgccccggtggctcagcctcacggcggggcggggggcgcggggccgccgggggggcgcggcgtgtgcatccgcgagttccgtgcggccgagcaggaggcggcgcgccgcatcttctacgacggcatcatggagcgcatccctaacacggccttccgcggcctgcggcagcacccgcgcgcgcagctgctctacgccctgctggcggcgctgtgcttcgccgtgagccgctcgctgctgctgacgtgcctggtgccggccgcgctgctgggcctgcgctactactacagccgcaaggtgatccgcgcctacctggagtgcgcgctgcacacggacatggcggacatcgagcagtactacatgaagccgcccggctcctgcttctgggtggccgtgctggatggcaacgtggtgggcattgtggctgcacgggcccacgaggaggacaacacggtggagctgctgcggatgtctgtggactcacgtttccgaggcaagggcatcgccaaggcgctgggccggaaggtgctggagttcgccgtggtgcacaactactccgcggtggtgctgggcacgacggccgtcaaggtggccgcccacaagctctacgagtcgctgggcttcagacacatgggcgccagtgaccactacgtgctgccgggcatgaccctctcgctggctgagcgcctcttcttccaggtccgctaccaccgctaccgcctgcagctgcgcgaggagtgaccgccgccgctcgcccgcccgcccccccggccgccctgtccgcctttgcccgcctgcccgccgcccggcgcggcctgctttcagacgctcaattggcgtttgtgttgggtttccccttttcaacatcctgcggttgtctggctggttccggggggtgcggggctgttgttcttcggcgacactttggtgggggtgggttgtttgtcgccatagcccctcgcccttccccacctgcctgggcggcttgccacctgaagagtggcatcttggaccaccgcggctgtccatgacgctgccctgcccgccgccactggggaaggcccagccttgctcaccaagcacagaacctctgcagcagatcccggggccaggctccggccccgcctgcggccccagcgccactgcctgtggaggccccagctggccacggcgctgctttgctccgcgcatgccgagggtgtggcccggctgagcatgccgcatgcacacagccccgccctgccgccctgcccagactggacccggagacccgggctggtgagcgcccctgtccccagcccccagctggctgtgggagggcctgcccctgcccccacctcctggagggcctggtctgccccgcgccgcccggctctgtccacacctgctttgctctgacgccctccatttctctggctccggcccctcccctgcctgggctgtgctgactggtgtcatcacccaggtgactcccatggcgtccgtggcacagccagggtgggggtccatgggacccctctccccagtgcccactggatcgtgctggcctctcccagatgtccccggggacctcctgcctctggctgacggtccaccctgtgaatcttatcagcccaggctgctgccaacagcgcccagcccacagcttctcccagcctgaaaccaacacattttctaataagttatttagacagaatagcactctgcatgactttaattcttgggacaaaacggtagtttgtaccctaagacacagtttctggcccagtgtgatgggggtgggtggccgggtgggtggagcgttttgctgttggaaacctggagggaaaccctgattggatgtcatttcctgccatggagcacgcctcccagccctggcctgcagtgtgggcagggtggggggcaagggagtccgcagcctccgggaggaggggcagggcgctgccttgggctgggtgggaagaggggtggccgcctcggcttccgctggccatgctcctggtctctccttcctgaggtcacaggcaggggctgccctggacggggggcggggggggtggcctggaaggggagacagaggtggagggtggcacaggctgcacattcagcttagaagtggacctggctttggtggcaggagaagaataaacacttgcccagacccctttgtgtgggggaattggggaggggtcgtggcaggcagggtgggccacggaactgggtcccaggcatcaaggccacgtgcagggccatggagggatgcttctcacgaggcgcttcagaagcgagcgaagggacagagaagccctgcgtccaagggccttttgtcctgttagcaattgaggtgtgcagagcactgtacagaccccactcccctgtacattcctccctggaggtgcccggtccccgcttggggatgggagttttgtagactgtacagaaatcggcaccctattttcttgcagctcagattttgttaatctggaatatacagacagacgtaaagtgttttagcaaaatggaaacaaacagttgtgcctttttcctcttttggtttggtttgggtttggcctggggctggtcccagttggtgcggggcatgctgggggcaggaggggcagggcgggccaggtggagtcaggtcttgggggtgtcatgtcggggtgctgccagcgtcccttggtcctgtgcctttggagcctcgggctcctggggtgcagggtgcttgggggtggctgttggagcccaccgacgccagggcagggcctggaggcccagggactgccagtgtctccttgatattgatcctagcagatccccctcctgggggttctgagagtcctgggcagtgtggccttctctcattctggtggcatctgcgcccgtgagtgacctcttccttggctgcactgccctgtgggtggtgagacgcttggccttttttgttgctgccaggacttggtagagatggcaggaagggtgtgcggggtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacatgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggccacccctctcctgctctgggtgtccttctcagagaagatggcagaaggctgcaggccctagaggggacgacgggctggggacgccctgagcttcctggctgtgtggcaggtgctggggaagctctctgggccatagggacctggctcccctctgagaggcccgcctgccctggggcacccagggctgtgctggtggcctgaggctgggaacttgggttcctgggctctgctggcgcctgggctttgtgggggccgaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccatggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtgcaagtgggttcttggatatgtgtagtgtgagcatgtgtgcatgtgtgagcctgtgcacgtgcatgttgtaggtgcataagcatgtacacgcgtgagcatgcatgtgtgtgtacacgtgtataggtgtacatgtgcatgagttgtgtacatgcgtgagcacgtgtatagatgtacgtgtgtgtgcgcatgtgtgcgtgtacatgtgtttgtgtcttgggtatgcataagcatgcacgtgtgtatgaatgtgcgtgtgtatgcatgagcacgtatgcatgtgtgatgcgcatgttcttgtgtacttctctgagggggcacatatgtatgagtgtatgagtgcatacatatgcatatggtgtacgtgtgtgtactttgtgtgtgggcatgtatgcgtatgagtacttgtgtgtggctggtgtatgggtgagcatgcacatgtgtatggatgcatatgtgagctgtacatgtagagtgtacatgtgtgttgcatgagcatgcatgcgtgcgagtgcctgtgtgtgtacttgcatatatgtggctgtgcaggtacccggcggtggtgggctggcagtgcccggggaagcaggtcctgctcacggcttccctgctgggccccaggccccgggctgagcctccctggcccctcttgcccctcagtggagcagggcctgggtggagggcctgggcagctccagggcaggtccggggaggccaggcttggggagcacagggggtggggttcacctgctgctgtttgttcccgaaactgtactgtgagcccacggcgggggcagattgttctgaggccccagatgtgccaaaacagcccccagggtgggggcgagcgagttctgaggagaggggctgcgggggccgggggtgggtgtgtgcccctcccctgaatggcccccaatgctgctgtttttcaataaaaccagagttgaaggc

SEQ ID NO: 157353 - DNA, 1875 bp, Homo sapiens
  Payload ID: 10845
  Gene Symbol: NAT9
  Gene Name: N-acetyltransferase 9 (GCN5-related, putative)
  Uniprot ID: Q9BTE0
  ENST ID: ENST00000357814
  CDS Start-End: 75-698
gggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccagcaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataaaacaaacattataaaacgaa

SEQ ID NO: 157354 - DNA, 1860 bp, Homo sapiens
  Payload ID: 10845
  Gene Symbol: NAT9
  Gene Name: N-acetyltransferase 9 (GCN5-related, putative)
  Uniprot ID: Q9BTE0
  ENST ID: ENST00000580301
  CDS Start-End: 83-703
ccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtggacaggcctttctccttagaggccagaggtgctgccctggctgggagtgaagctccaggcactaccagctttcctgattttcccgtttggtccatgtgaagagctaccacgagccccagcctcacagtgtccactcaagggcagcttggtcctcttgtcctgcagaggcaggctggtgtgaccctgggaacttgacccgggaacaacaggtggtccagagtgagtgtggcctggcccctcaacctagtgtccgtcctcctctctcctggagccagtcttgagtttaaaggcattagtgttagatacagctccttgtggctggaaaacacccctctgctgataaagctcagggggcactgaggaagcagaggccccttgggggtgccctcctgaagagagcgtcaggccatcagctctgtccctctggtgctcccacgtctgttcctcaccctccatctctgggagcagctgcacctgactggccacgcgggggcagtggaggcacaggctcagggtggccgggctacctggcaccctatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgcctcagtataa

SEQ ID NO: 157355 - DNA, 573 bp, Homo sapiens
  Payload ID: 10845
  Gene Symbol: NAT9
  Gene Name: N-acetyltransferase 9 (GCN5-related, putative)
  ENST ID: ENST00000582524
  CDS Start-End: 109-531
gcgcatgcggaaggggcggtagccggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccagcaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggaggtgaccctcagactgacagtgagtgagtccgagcatcagtggcttctggagcagaccagccacgtgga

SEQ ID NO: 157356 - DNA, 583 bp, Homo sapiens
  Payload ID: 10845
  Gene Symbol: NAT9
  Gene Name: N-acetyltransferase 9 (GCN5-related, putative)
  ENST ID: ENST00000583757
  CDS Start-End: 86-505
cggccgggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggaggtgaccctcagactgacagtgagtgagtccgagcatcagtggcttctggagcagaccagccacgtggaagagaagccttacagagatgggtcggcagagccctg

SEQ ID NO: 157357 - DNA, 839 bp, Homo sapiens
  Payload ID: 10845
  Gene Symbol: NAT9
  Gene Name: N-acetyltransferase 9 (GCN5-related, putative)
  ENST ID: ENST00000578822
  CDS Start-End: 172-810
ctttctgcgggggacgatttcgtcggtggtagaattttggagtctgtattctttgaagtgtctagacggaactaatgacggaagtcaacttagccccagcaggaaagctggagcgcctacccaaagttggaggaaattcagggtcctgaagtctttgctctccccatctgcatgcaggctgctaccatgaggttgaatcagaacaccttgctgctggggaagaaggtggtccttgtaccctacacctcggagcatgtgcccagcaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgt

SEQ ID NO: 157358 - DNA, 583 bp, Homo sapiens
  Payload ID: 10845
  Gene Symbol: NAT9
  Gene Name: N-acetyltransferase 9 (GCN5-related, putative)
  ENST ID: ENST00000583476
  CDS Start-End: 81-488
gggcctgggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccagcaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacgaaacttcactttgagcaggtggctacgagcagtgtttttcaggaggtgaccctcagactgacagtgagtgagtccgagcatcagtggcttctggagcagaccagccacg

SEQ ID NO: 157359 - DNA, 799 bp, Homo sapiens
  Payload ID: 10845
  Gene Symbol: NAT9
  Gene Name: N-acetyltransferase 9 (GCN5-related, putative)
  ENST ID: ENST00000580632
  CDS Start-End: 10-633
gctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagcttgggacaggagggtgggggcaggcgcctccttacttgcccctgtctcatctcctctgcgaggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagt

SEQ ID NO: 157360 - DNA, 497 bp, Homo sapiens
  Payload ID: 10845
  Gene Symbol: NAT9
  Gene Name: N-acetyltransferase 9 (GCN5-related, putative)
  ENST ID: ENST00000581466
  CDS Start-End: 251-497
agattgggatagtggtgctgtagatgggtattctctacttgtagttttccgtttgagggttcctggtgccctaacttcgtgggatctgtccagccgcctttgttgaggttggcttgccatatacatccccttctggaatttgaagaatgtttggtttcagactgctcctccgcactgacccgagacaggataggaaattggacagatagaactgactcgtcctgctgttcttgtcaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagccca

SEQ ID NO: 157361 - DNA, 1011 bp, Homo sapiens
  Payload ID: 10845
  Gene Symbol: NAT9
  Gene Name: N-acetyltransferase 9 (GCN5-related, putative)
  ENST ID: ENST00000581136
  CDS Start-End: 68-676
tggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccagcaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagaccagagccctgcactgggagagtgctcctggcccaggctgggaatcacctttcgaggcccttcagactctggcggggcttgctgtggcctccctccagctagtggtgtggctgagcagactccagggccagggccagttcccttctcccctcccggccaaacccagacccagactctaggaagctggaatggagggcagggatccatgggagatgtcgggatgaaggtgggagctggaggtgcagggggacctggaacatggatgggagtgg

SEQ ID NO: 157362 - DNA, 394 bp, Homo sapiens
  Payload ID: 10845
  Gene Symbol: NAT9
  Gene Name: N-acetyltransferase 9 (GCN5-related, putative)
  ENST ID: ENST00000578947
  CDS Start-End: 68-394
ggaagtaggtttaaggcagggctgaaagttgattctgggttggaatccctggactggggctgctaccatgaggttgaatcagaacaccttgctgctggggaagaaggtggtccttgtaccctacacctcggagcatgtgcccagcaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatg

SEQ ID NO: 157363 - DNA, 583 bp, Homo sapiens
  Payload ID: 10845
  Gene Symbol: NAT9
  Gene Name: N-acetyltransferase 9 (GCN5-related, putative)
  ENST ID: ENST00000579218
  CDS Start-End: 33-583
gggaacgtggctggttggaggaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatca

SEQ ID NO: 157364 - DNA, 896 bp, Homo sapiens
  Payload ID: 10845
  Gene Symbol: NAT9
  Gene Name: N-acetyltransferase 9 (GCN5-related, putative)
  ENST ID: ENST00000582870
  CDS Start-End: 197-832
ggctggttggaggaggtagatcaccctttctgcgggggacgatttcgtcggtggtagaattttggagtctgtattctttgaagtgtctagacggaactaatgacggaagtcaacttagccccagcaggaaagctggagcgcctacccaaagttggaggaaattcagggtcctgaagtctttgctctccccatctgcatgcaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcagagcccagctgcaggggtaagggccttggcactgaggccgttctcgcgatgctgtcttacggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtgagcagggtgttgggcccatacacttcaaagac

SEQ ID NO: 157365 - DNA, 584 bp, Homo sapiens
  Payload ID: 10845
  Gene Symbol: NAT9
  Gene Name: N-acetyltransferase 9 (GCN5-related, putative)
  ENST ID: ENST00000581451
  CDS Start-End: 416-584
agagccccgtggggtggtcgccggggtaagaggttggaagtaggtttaaggcagggctgaaagttgattctgggttggaatccctggactggggcaagtaatgggagctctggggatactttggtacttggtacttggtgcttgggtttgaggaatcgaagttctggggagtggacggaaggaaccggcagaaacggagcccaggcttggcctcttggagtgggagtcaaggattgtttaattatccttaaccagcctggttctctttcttgcaagaattttggagtctgtattctttgaagtgtctagacggaactaatgacggaagtcaacttagccccagcaggaaagctggagcgcctacccaaagttggaggaaattcagggtcctgaagtctttgctctccccatctgcatgcaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatg

SEQ ID NO: 157366 - DNA, 1103 bp, Homo sapiens
  Payload ID: 10845
  Gene Symbol: NAT9
  Gene Name: N-acetyltransferase 9 (GCN5-related, putative)
  ENST ID: ENST00000584022
  CDS Start-End: 75-545
gggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccaggtaccacgagtggatgaaatcagaggagctgcagcgtttgacagcctcggagccgctgaccctggagcaggagtatgccatgcagtgcagctggcaggaagatgcagacaagtgtaccttcattgtgctggatgccgagaagtggcaggcccagccaggcgccaccgaagagagctgcatggtgggagatgtgaacctcttcctcacagatctagaagacctcaccttgggggagatcgaggtcatgattgcaggaggaggccctcctgtttctgctccttcatggtcctcagtttcccccaagtggctactgactatccccatgaggcagcatactgactccatgagaatggtaatgatagtagcaacttcagagttgttgagaattaaatgagatggtgtctgccaagtgcccgcactggagcctggcacacggcgtcagcgccgctcctgttgtctctcctagagcccagctgcaggggtaagggccttggcactgaggccgttctcgcgatgctgtcttacggtaagaaagtgtgagcagacaatgcgggaagtgggcaggccccaggtgaactttgttcaggtgtgagggttgggggcaggtgaaggttcctcctctgcagcttgggacaggagggtgggggcaggcgcctccttacttgcccctgtctcatctcctctgcgaggagtgaccacgctaggtctgaccaagtttgaggctaaaattgggcaaggaaatgaaccaagcatccggatgttccagaaacttcactttgagcaggtggctacgagcagtgtttttcaggaggtgaccctcagactgacagtgagtgagtccgagcatcagtggcttctggagcagaccagccacgtggaagagaagccttacagagatgggtcggcagagccctgctgatggctgggccttgtgggcagccactctgtgtga

SEQ ID NO: 157367 - DNA, 4931 bp, Homo sapiens
  Payload ID: 10846
  Gene Symbol: NATD1
  Gene Name: N-acetyltransferase domain containing 1
  Uniprot ID: Q8N6N6
  ENST ID: ENST00000611551
  CDS Start-End: 147-488
actttcagcgccgccgcctgcggtctcccaggccgtaactaccccaccgcctgccgcctgcgcccgcgctccagccccgccgcgcgcctgacctttccccgcgcgccccggcccccgccggcgccgcgccgcagccccgcgcgcagatggcgcactcggctgccgccgtgccgctgggcgcgctggagcagggctgccccatccgcgtggagcacgaccgccggcgccgccagttcactgtccggctcaacggatgtcatgaccgggccgtcctgctctatgagtacgtgggcaagcggatcgtggacctgcagcacaccgaggtcccagatgcctaccgtgggcgtggcatcgccaagcaccttgccaaggccgccctggacttcgtggtggaggaggacctgaaggcccatctcacctgctggtacatccagaagtacgtcaaggagaaccccctgccgcagtacctggagcgcctgcagccgtaaccctggcctgcaggcgggagcgctccctgccggactcttccacgtggcctttgcctggccccacgtgctctcaggaacctggtcccactgggaacagactcagagttatttttgtaaggacactcatctgtgccccacgtccagatccctggaggcagctgaccaatgatgggcggtgacccggtaaccgaggcggcaaggaggccaggtagtcccggcacctctcactctgcagagaccagcggcttcgtgggaggcctgtgggtcacacgtaggggctagagccagcctgcatcctgcccaccgggctccacttggagatcagcaggagggccagtgtgggacccctgctgccacctctcctgggcctgtgtcctttctggaaattaagaaggtgtgctccagagccaagaggagcaataagaaacctcgtgtgccagcttctgagggtggcagtgccagaccccacctgccagcggtgctgcccctttctcagacccccatgcccagtgcaggcagggccctggaaagggtcagctctccctgacagagaccagcagagtgaaggactgagcactggccaggctcaaccgtacgtgcggttcacacatgtgaacacacaggatgcagtctacaggcgggctggtggtgggtgccgggggtgttttcctctccttggtacccccatcttttttttggcctctcgtgtaggttctgcaggaaaccaaggccccatccccatgggctgctatcccctatacccctgtctgccaggaggagatccaagggggcctgagcagctgcaggcccgccccttgctggccttggccacctgcctgagccttctccgaggagatgccttggggctggggtgggagtgaagctgactattctccaaaaaccaccctcagcatccaagaggaagaaacatcagccacaggggtttctgtgctgctgccagacatcagtgtcctcttttgtggctggctacagccggatacactttgctgcccatctggccctgggctcctccccaacccagccttcctgggtgcagcctgggagacacactagcatgctttggtgggaccagcctttccagggcatgctggcttcccctggggctgactcaggtcccgccctcttgtgtcagtgctaacaaggatcagattcgtccctgcccttctgtagagctggagggtgacctggagccaggggccctttagggctgagacatttgttagtcggagtgatgcatccctacccggcttcggggggagtcaggctgggctctgggcagtacagggagaggttcaccaggacccccatgccttcctcccccggtgcaggggcagtggtcaccatgctgactcctccctttgactccatgcacgggcgctggctggcctgtggttgcatttcccactcacctccttgctatccccagtcttggcaccgagaccccccacattccttctccagcaacagcagcccaggggccttcctgcctggacgcaggaccacggagacctgcatgtgcagggaggcctggcagcctgccgatgggggtccccgagccccggagtctcctcgaaacccctgctgtgggtcacagcatggaccaggaggggtcaccatcctgagtacccccgacatccctgccccttgacctgtggcagatgctcctgccctggcctccaggaagtcagctcttttgcaaagggcttgtgtgagaggtcggagaaagccctgggcctccagggagatgcagctggcaggaggtgggctgagctgctccggggctaggggtggcccattgctggcagaatttaaggaaagagcaggttgtaggcacagaggatgggcagccaggcctgggccttccccttactgtcccagggcagcagagctagggtcctcttttaccctccctaaggtcacccccttcccatctacacgtccctccccaagttcaagcacatagtcaatcatgaccactcaggagctcagtgagctggggccatgtccctgtggcctccagcccatccgcaggagggtcccttgcagtgacagcacaaagagtcccccacaggaagcccctgagggccagcatggaccttgagagccaggagggaatgggcctggtgccactctgttcccactcccacctaagattcctacccctgtgttctagcaggtgactcttgatctggccagcccacaacaaatacttgaactaggcagcatggggtggtggaggcctgcagaggccccgggcccaggaactgagactagggctttctcatgaggcctcatcaagctcccgcaggtatgacctggcctcctcgcctcgggctgccttaaagcaccgctaacccacgccaaggggctaggcagggcttcgcggggcctggcccaaggtctccagcagagcaataacatcttcccaggttgggttgccacagacaccgtgccctggagcccccagcccatcccatctggtgctaccctgtctgcctggcagcctagcctcacccctcctgtccggtcacctgggggtccttggtaaggatgccgccacatggggccggtttatgcacctgggcgagaacctgactggggcaggggatgctcaggggcctgcaggtctcccacagagctgcttttctgcccgcctcaccctgtgggtttgtatttcttgccgggtcaaaataggcagtgactcgtgccttccctcctcagggccggcggcagggtgtggacccagctggccgctggaccgtccccttcctcattctccaagctcatcaacaggtctcagaggaacatttccataaaaggtgtggcctggcatgcagtgctgtctgcacgctgtcgcttcccccacagcaacctgccggtcagccttaactggtgtggaggtcgaggtggggagggggaggcgggcttccctccctggtgtctggcctctttttgctcagccctcagcacagccttcagcgtggagagcgagaccctgcgtgtcactggggcttggctgaggtctccctgcaggataacagtgacttcaggaacccagaccccagtctgggcggctctaccttcccggctggcccagcccccacaccacagttccctgccacctccaggcacaaaagcctctgaggccacagcccagctatgaagctgagtggctttgtgcggtctcctagggaaggggcagtgatgccatgcatgagatccgctgtgccataagaagttgcttcctttagaatttctggtccaatgcagggaggtgaggcccagcctcatgataacacatgcccatcaaggaaaagctgtggctaatgcttccaaaacaagtgaaaatcttgcaccaggcccagggccatatctcattccgccccagctactgagggaggggacagactgctggaggacaatttctcctagttaccactaggggttacatggctactcagaatgaaagataaattgccaggcctgttgcaatcttttttttgagatgggagtcttgctctgtcgcccaggctggagtgcagaggtgcgatctcagctcactgcaacctccacctcccgggtcaagcaattctcctgcctcagcttcccgagtagctggaattacaggtgcccaccaccatgcctggctaatttttgtatttttagtagagacggggtttcaccatgttggccaggctggtcttgaacacctgacctcaaatgatccgcccacctcggcctcccaaagtgttgggattacaggcgtgagccacctcaccaggccccgttgcaatcttactccacttcgttttcacagcagtcccgggacatgcccattattaggcctatttgatagatgatactgaggctgagtcgggggtcacaagccaaagccacaccgctagaagggctcaggacccagcccagctcccgtcctcttggtggcatcaagcttgtgtgatatgaggtcttatgtctgctcatgacagccttaaaagcaataaacagatacaacttccagcaacttcccactcagctgcaaggctgcgggggggtcctgcctcgagccataaggtgagcagctagccagtgccgggccagtgtggagaaggctgaattgcctgtgaagctggggttgcaggcaggaatattcatggagcccctgaccatgtactcacactgctcttcctcagttcagggttcttggatttgctcaagtccacccaaatatccctttacgattctcagggtcccactccttccagatccaatgccctaaactttacataagagttccggcaaggctgtgacttcaacttgtgttgtaactgcaacctgcagaatcaaatttagggttatgttttcagttgtatcagtcttacggctacaagatattaaagagattcttttctggttatcaaa

SEQ ID NO: 157368 - DNA, 7254 bp, Homo sapiens
  Payload ID: 10847
  Gene Symbol: NWD1
  Gene Name: NACHT and WD repeat domain containing 1
  Uniprot ID: Q149M9
  ENST ID: ENST00000379808
  CDS Start-End: 32-4330
ataccctccatgcccttccttgcagatatggatgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaattcctgatagagtctcaataaaagcaaccttagaaacagaggcttttgagctgaacaagaccctactgctgtcttattcatccattttccaaaccagttttccaaggcaggttttggtagttctgcaaatgttagtgtcaaatttcatttaaaaatattttaaactgtaattttaagatgtatgcttggatgtattgggcagcagcttctaaggtgttgaagattactaaggttggtgcaaaaagtaactgtggttttcgccattaaaaatattaaaaataatggcaaaaactggctgggcacagtggctcacacctgtggtcccagctctttggaaggccgaggcaggtggatcacctgaggtcaggagtttgagaccagcctggacaacatggtgaaacccttctctactaaaaatacaaaaatcagccaggcatggtggtgagtgcctgtaatctcagttactcaggaggctgagtcaggagaatcacttgaacccgggaggcggaggttgcagtgagctgagattgtgccactgcactccagcctgggtgacagagcaagactccatctcataataataataataatggcaaaagcctcggtggctcacgcctgtaatcccagcactttgggaggctgaggcgggtggatcacttgaggccaggtgttcaagagcagcctggtcaacatggtgaaactctgtctctactcaaaaatacaaaaattagcctggtgtggtgacgtacacctgtaattccagctacttgggaggctgaggcaggagaatggcttgaacccgggaggcggaggttgcagtgagccgagatcgcaccactgcactccagcatgagtgacagagactctgtctccaaaaaaaaaaaaaaaaaaaagtaatggcaaaaaccacaattaattttgcatcaacctaataatttaggattcttctgccattttcatttaactgatttaactgaagagcccaattaaattgtgaagggagccctgaaaaaattagctactctttgccactgcttctctgtgaatcaagggcttacccaatgcagaaataaagtagatgttgagaccaattaagatttcacctacaaattctgattttaaatgcctgtgtccatctccacagcctcagtgagaattgattgttttgtagataaatcctaatttaaacattggaaatgcctttttactaataaaatgctacaacaaattattgctta

SEQ ID NO: 157369 - DNA, 6162 bp, Homo sapiens
  Payload ID: 10847
  Gene Symbol: NWD1
  Gene Name: NACHT and WD repeat domain containing 1
  Uniprot ID: Q149M9
  ENST ID: ENST00000438489
  CDS Start-End: 4-234
tggatgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgagaaatgtgctgatccctgtcctggacagtaaagagggaaaaagtaaagaaaagtaccatggccaggccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacgagttcttactgcagaggggtccaatgtgcttgcttctccaaggatgacaagtatgtgtacgtgggcttaaaggatcgctctatacttgtttggagtgtgctggatggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaat

SEQ ID NO: 157370 - DNA, 8393 bp, Homo sapiens
  Payload ID: 10847
  Gene Symbol: NWD1
  Gene Name: NACHT and WD repeat domain containing 1
  ENST ID: ENST00000518676
  CDS Start-End: 646-1185
gaggagtctaaattggtcgttcaactaccagcaaaggctaaagagaggctggagcccccaggacagccagaacgctgacactgcaaagggcctctgtccttactggggaagcccagtcctgctcagctgtcttcttcagcaacaaacagaagtccagaaagagaaacagttgtggaggaagctgttgtgatgataatttactgagcacctactatgtgccaggcacgccagccttaccagacaagatccttgggctcatggaattcactttctcgtgggacagacaaacaataacatgtagaaacatatcagctgttgcaggcagtaaccaagggagcgtggccaggcgctgaagtgaattcgggtccaaggagcctgctgggacccaggaaaacgagagaaggaacagaaattgtggtggaggcaaattcaagatcagaagattggggaggaggtgctaagagaggtctggagagatgctgggacccagaactggggcctcagtgagatcagcaggctgcagctaaactgtggtatccagaccatgcggccgatgccctgggagggagaccacttgcttaagtcctccaggagggcgatggaggagccggcattccaaccaggctcacggatgccaagatatggatgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcaggtgaggccgcagggactcccctctggagacccacaagaaactgaccacgtgttcagaatatccatcccctgttggcaaaaatgcaacagtctgcatttcttgcaaatgccaaaccagtcaacctctggtccctcggctctgagaaaggctgttttactgatccaagatagttcagccatgttcctgatcaatcttggtctcaggatcttcctctcctcgctggctctttcttcttgtctcccagggaggttcctggcacaggggccgtattagtctgttctcatgccactaataaaggcatacttgaggctgggtaatttacaaaggaaagaggtttaatggactcacaattccacatggctggggaggcctcacaatcatggctgaaggcaaaggagaagcaaagaggcacatcttacatggtggcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacgagttcttactgcagaggggtccaatgtgcttgcttctccaaggatgacaagtatgtgtacgtgggcttaaaggatcgctctatacttgtttggagtgtgctggatggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaattcctgatagagtctcaataaaagcaaccttagaaacagaggcttttgagctgaacaagaccctactgctgtcttattcatccattttccaaaccagttttccaaggcaggttttggtagttctgcaaatgttagtgtcaaatttcatttaaaaatattttaaactgtaattttaagatgtatgcttggatgtattgggcagcagcttctaaggtgttgaagattactaaggttggtgcaaaaagtaactgtggttttcgccattaaaaatattaaaaataatggcaaaaactggctgggcacagtggctcacacctgtggtcccagctctttggaaggccgaggcaggtggatcacctgaggtcaggagtttgagaccagcctggacaacatggtgaaacccttctctactaaaaatacaaaaatcagccaggcatggtggtgagtgcctgtaatctcagttactcaggaggctgagtcaggagaatcacttgaacccgggaggcggaggttgcagtgagctgagattgtgccactgcactccagcctgggtgacagagcaagactccatctcataataataataataatggcaaaagcctcggtggctcacgcctgtaatcccagcactttgggaggctgaggcgggtggatcacttgaggccaggtgttcaagagcagcctggtcaacatggtgaaactctgtctctactcaaaaatacaaaaattagcctggtgtggtgacgtacacctgtaattccagctacttgggaggctgaggcaggagaatggcttgaacccgggaggcggaggttgcagtgagccgagatcgcaccactgcactccagcatgagtgacagagactctgtctccaaaaaaaaaaaaaaaaaaaagtaatggcaaaaaccacaattaattttgcatcaacctaataatttaggattcttctgccattttcatttaactgatttaactgaagagcccaattaaattgtgaagggagccctgaaaaaattagctactctttgccactgcttctctgtgaatcaagggcttacccaatgcagaaataaagtagatgttgagaccaattaagatttcacctacaaattctgattttaaatgcctgtgtccatctccacagcctcagtgagaattgattgttttgtagataaatcctaatttaaacattggaaatgcctttttactaataaaatgctacaacaaa

SEQ ID NO: 157371 - DNA, 7641 bp, Homo sapiens
  Payload ID: 10847
  Gene Symbol: NWD1
  Gene Name: NACHT and WD repeat domain containing 1
  Uniprot ID: Q149M9
  ENST ID: ENST00000524140
  CDS Start-End: 419-4717
agtctaaattggtcgttcaactaccagcaaaggctaaagagaggctggagcccccaggacagccagaacgctgacactgcaaagggcctctgtccttactggggaagcccagtcctgctcagctgtcttcttcagcaacaaacagaagtccagaaagagaaacagttgtggaggaagctgttgtgatgataatttactgagcacctactatgtgccaggcacgccagccttaccagacaagatccttgggctcatggaattcactttctcgtgggacagacaaacaataacatgtagaaacatatcagctgttgaccatgcggccgatgccctgggagggagaccacttgcttaagtcctccaggagggcgatggaggagccggcattccaaccaggctcacggatgccaagatatggatgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaattcctgatagagtctcaataaaagcaaccttagaaacagaggcttttgagctgaacaagaccctactgctgtcttattcatccattttccaaaccagttttccaaggcaggttttggtagttctgcaaatgttagtgtcaaatttcatttaaaaatattttaaactgtaattttaagatgtatgcttggatgtattgggcagcagcttctaaggtgttgaagattactaaggttggtgcaaaaagtaactgtggttttcgccattaaaaatattaaaaataatggcaaaaactggctgggcacagtggctcacacctgtggtcccagctctttggaaggccgaggcaggtggatcacctgaggtcaggagtttgagaccagcctggacaacatggtgaaacccttctctactaaaaatacaaaaatcagccaggcatggtggtgagtgcctgtaatctcagttactcaggaggctgagtcaggagaatcacttgaacccgggaggcggaggttgcagtgagctgagattgtgccactgcactccagcctgggtgacagagcaagactccatctcataataataataataatggcaaaagcctcggtggctcacgcctgtaatcccagcactttgggaggctgaggcgggtggatcacttgaggccaggtgttcaagagcagcctggtcaacatggtgaaactctgtctctactcaaaaatacaaaaattagcctggtgtggtgacgtacacctgtaattccagctacttgggaggctgaggcaggagaatggcttgaacccgggaggcggaggttgcagtgagccgagatcgcaccactgcactccagcatgagtgacagagactctgtctccaaaaaaaaaaaaaaaaaaaagtaatggcaaaaaccacaattaattttgcatcaacctaataatttaggattcttctgccattttcatttaactgatttaactgaagagcccaattaaattgtgaagggagccctgaaaaaattagctactctttgccactgcttctctgtgaatcaagggcttacccaatgcagaaataaagtagatgttgagaccaattaagatttcacctacaaattctgattttaaatgcctgtgtccatctccacagcctcagtgagaattgattgttttgtagataaatcctaatttaaacattggaaatgcctttttactaataaaatgctacaacaaattattgctta

SEQ ID NO: 157372 - DNA, 6964 bp, Homo sapiens
  Payload ID: 10847
  Gene Symbol: NWD1
  Gene Name: NACHT and WD repeat domain containing 1
  Uniprot ID: Q149M9
  ENST ID: ENST00000552788
  CDS Start-End: 1-4695
atgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtgtggagtctgtcagaacaggggacccttctggacatcctggaaggcgtcggggcccccgtgagcctgctggcccgcggcggggctttggtggcatctgcttccccacagtcctcatctttcaaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacgagttcttactgcagaggggtccaatgtgcttgcttctccaaggatgacaagtatgtgtacgtgggcttaaaggatcgctctatacttgtttggagtgtgctggatggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaattcctgatagagtctcaataaaagcaaccttagaaacagaggcttttgagctgaacaagaccctactgctgtcttattcatccattttccaaaccagttttccaaggcaggttttggtagttctgcaaatgttagtgtcaaatttcatttaaaaatattttaaactgtaattttaagatgtatgcttggatgtattgggcagcagcttctaaggtgttgaagattactaaggttggtgcaaaaagtaactgtggttttcgccattaaaaatattaaaaataatggcaaaaactggctgggcacagtggctcacacctgtggtcccagctctttggaaggccgaggcaggtggatcacctgaggtcaggagtttgagaccagcctggacaacatggtgaaacccttctctactaaaaatacaaaaatcagccaggcatggtggtgagtgcctgtaatctcagttactcaggaggctgagtcaggagaatcacttgaacccgggaggcggaggttgcagtgagctgagattgtgccactgcactccagcctgggtgacagagcaagactccatctcataataataataataatggcaaaagcctcggtggctcacgcctgtaatcccagcactttgggaggctgaggcgggtggatcacttgaggccaggtgttcaagagcagcctggtcaacatggtgaaactctgtctctactcaaaaatacaaaaattagcctggtgtggtgacgtacacctgtaattccagctacttgggaggctgaggcaggagaatggcttgaacccgggaggcggaggttgcagtgagccgagatcgcaccactgcactccagcatgagtgacagagactctgtctcc

SEQ ID NO: 157373 - DNA, 6614 bp, Homo sapiens
  Payload ID: 10847
  Gene Symbol: NWD1
  Gene Name: NACHT and WD repeat domain containing 1
  ENST ID: ENST00000549814
  CDS Start-End: 252-4820
gctgacactgcaaagggcctctgtccttactggggaagcccagtcctgctcagctgtcttcttcagcaacaaacagaagtccagaaagagaaacagttgtggaggaagctgttgtgatgataatttactgagcacctactatgtgccaggcacgccagccttaccagacaagatccttgggctcatggaattcactttctcgtgggacagacaaacaataacatgtagaaacatatcagctgttgatatggatgcagagagggaagccctgcagagcactgcctaccctgaagtgccagaccttctgccagaggcacggcttgatgtttgaggtcgttgatctgaggtggggtattcggaacattgaagccactgaccacttgaccacagaactctgcttggaggaggttgaccggtgttggaaaacatccatagggccagcttttgttgccctcatcggtgatcagtacggcccctgtctgattccctcgcggatcgatgagaaggagtgggaggtattgagggaccatctgactgccaggccaagtgacctggagctggtggcacgatacttccagagggacgagaatgcgtttcctcccacctacgtcctgcaggcaccaggtactggggaggcctgtgaaccagaggaggccaccttaacttctgtcctacgctctggagcccaggaggcccggaggctggggctcatcacccaggagcagtggcagcactaccaccggtcagtcattgagtgggagatagagcggagcctgctgagctcagaggaccgggaacagggagccaccgtcttccttagagagatccaagacctccacaaacacatccttgaagactgcgcccttaggatggtggaccggctcgcggatggctgcctggacgctgatgcccagaaccttctcagcagcctcaaaagtcacatcactgacatgcacccaggggtcctcaagacccaccgcctgccgtggagccgcgacttggtgaaccccaagaacaagactcacgcctgctacctgaaggagctgggtgagcagtttgtggtgagggccaatcaccaggtcctcacacgcctccgtgagctggatacggccggacaggagttggcgtggctctaccaagagatccgccaccacctttggcagagctcggaggtcattcagaccttctgcggacgccaggaactcctggcccggcttgggcagcagctcaggcacgatgacagcaagcagcacacccccctggtactctttgggcccccaggcattggaaagacagccctgatgtgcaagctggctgagcagatgccaaggctgctggggcacaagacagtgaccgtcctgcggctgctggggacgtcacaaatgagctcagatgcccgtggcctgctgaagagcatctgcttccaggtgtgcctggcctatgggctgcccttgccccctgcccaggttctggacgcccacaccagggtggtccagtttttccataccctcctccacactgtctcttgcagaaacttcgagtctctcgtgctcctgctggatgctatggatgacctggactctgtccgccatgctcggagggttccctggctgcctctcaactgccccccgagggtgcacctcatcctctcagcttgctcgggggcactgggggttttggacaccttgcagcgggtgctcctggacccggaggcctactgggaggtgaagcccctttccggaaaccaaggccagcagatgatccaactcctgctggcagctgcaaggaggacgctgagcccggtgcacacagatttgctctgggccagcctcccagagtgtgggaacccagggcggctgaggctggcgtttgaggaagcccggaaatgggcctctttcaccgtgcctgtcccgctggccaccaccgcagaggaagccacgcaccaactctgcacccgcctggagcagacacacgggcagctcctcgtggcccacgtgctgggctacattgtgtcttcccgacacggtctctcggaggcggagctgaaggatgttttgtccctggacgacgaggtcctgcaggatgtgtaccgagattggaccccgcccagcaaggagctgctgcgcttcccgcccctgctgtgggtgcggcttcgtcgggatctgggatactacttggcccggcggcccgtggatggcttcaccctcctggccattgcccacagacagctggtcgaggtggtccgtgagcgctacctgtcaggatccgagagagccaagaggcatggcgtcctggccgacttcttctcagggacctggagccagggtaccaagaagctcatcactctgccacttgtggggaaaccactgaacttggaccgaaaggtggccccgcagcctctgtggttctcacatacggttgcaaacctgcggaagctgaaggagttgccctatcacctgcttcactcgggccgcctggaggagctgaaacaggaggttctgggcagcatgagctggatttcctgccggggcatctctgggggcattgaagacctgctggatgactttgacctgtgtgcccctcacctggactcccctgaggttggcctggtccgtgaagccctccagctctgccgccctgctgtggagctccgaggcatggagaggagcctcctgtacacagaactgctggccagactccatttcttcgccacctcacatccagcactggtgggacagctatgccaacaggcccagagctggttccagttgtgcgcacaccctgtgctggtgcccctcggaggattcctccagcccccgggaggacccctccgggcaactctcagcggctgtcacaaaggcatcaccgccatggcatggggtgtggaggagaagctgctggtgattggcacccaggatggcatcatggctgtgtgggacatggaagagcagcatgtgatccacatgctaactggacacacaggagaggtgaggtgtgtgaaaatatttgccaaagggaccctcgccaactctgcttcaaaggattacacgctgcacttgtggaacttactctctggccaggagaaatttaccatttgggatggaggctcaaaaaatcccgctgaacctcagatctggaaccttcatgtggatgaggcacacaaagttgtgtattcagcatctggctcaaagatcaatgcttggaatctggaaactgcagagccggtattccatatcctgggagatgcctctgatccttggatgtgcatggccgtgctggcctcccaggccacactgctgacagtgtccagggatggtgtggtcagtctgtggagctcagctacgggaaaacttcaggggaagcaacatatgtccagcatcaaagaagaaacacctacctgtgccgtctcagtccagaagcaaggaaagcttgttaccgggtttagcaatggctccatctctttggtttcctccaaaggggacagattgctggagaagcttccagatgctgtgaggttcctggtggtctctgaagatgagtccctcctcgccgcaggctttggaagatcggtgcggatattcttggcggactcgaggggctttcgccgattcatggccatggatctggaacatgaagacatggtggagacggctgtttttggtactgagaacaacctgatcatcacggggtcccttgatgcgctcattcaggtctgggatctcagcgatgctcataggtcccgggtgcctgcaccatttctggaccgcaccggcctcaccgcagtgtcccacaatggaagctacgtctacttccccaaaattggggacaaaaacaaagtcactatttgggacttggcagaaggcgaggaacaagattccctggacacctccagtgagatcaggtgtctggaggttgctgagcagcgcaagctcctatttacgggcctcgtgtcgggggtcgtccttgtgttccccctgaattccaggcaggacgtgatatgcattccccctcccgaggcccggaaagcaatcaactgcatgtccctgagcaagtgcgaggaccgcctggccatcgcctatgacaacatcgtcctggtgctggacatcacctccggggacccctgcccggtcatcgatgggccaagatacaccttttacactcagctgcccgagaccctctccagcgtggccattctgacggactaccgcgtggtctacagcatgaccaatggggacctctttctttacgagtgtgcaacttccaaagcgtttcccttggagacccacaggagccgagttgcctgtgtggaggtcagccacaaggagcagctggtggtcagcgggtctgaggatgccctgctgtgtctctgggacctgcaggcacgcaagtggaaattcgagatgagctacacgagttcttactgcagaggggtccaatgtgcttgcttctccaaggatgacaagtatgtgtacgtgggcttaaaggatcgctctatacttgtttggagtgtgctggatggcaccctgctgacagtccagtttgtccatgctgtggtaaacagaatcatcccaaccaccagtggcttcattgcccccaccaggcatggttatctgatccgagagaatttccagtgcctttcagcaaaagcctcaccgcaggaccctcttaagaacttcaagaaggcaatgtggatggtcaaatccaggcagagagaggagctagttgcagctgcaggagctccccaggacttggagtcagaaagtgcccagggaaatgaaaccaaatcaaacaaatgctcacaagtgtgcctgatagtgtaaaaaaataaaaataaaaaaaccctgtgggggtatggggctccagtgagttagccccatttaatctagttaaagcaaaaagaatacgtttgctggtgtatatctggacccatggcttcagattatggcttcagaccttgtctcttctcatctttccattattctttcctctttttcattttcattctcagacttgccacccccaggttagcaacatggtggccaatatgctgctgtctccaatttcaatagaaaagagagcttctctttcccaacagtcctagcctcaactctactggtcccaattggcccatacgcctagccctaaaccaattattatatctgggagaatgcagagctctaatcggctagactgatccaatgtccaccactgggactgagaatagaagagattactcctgagatgcaaactggagttctggtaccagatgaagggggaacggatgaatgtgagatacagcaaatcactgatgtggaccacagaacctcacagtttataaagctgtaggtgctgtcatctgatcctcatcacaactcatactttagggagggcaggagtttctgtatctattttacagatgaggaaactgagccttgcggaagtagttataatttgattcaggtcacaagtccaaggtgcaagagctctgagagtgagccttctgtcccattcctgttagacctcactccaatttcagtctgcagagcacaaccatctcttccacaggcaccacactcaaatgctcacaggagctagtgactaatctagacacttccatgcacctgggtgagcagcagggagagacagagactggacatgtggaaggcagagattgtgtctagggtgggtatgagcagcctgactgtagcccagaatcaccatggccaaacaagcccactgctgtcagtgcttccagttgtaataagcaaagccagaaatccagacttttatgcaaaaatgttctgacttttaaagttggcgattggttgaatttatatctatagtgcatttggcatgtgcgtctttggttaatgagctgacttcaggactcacgctggcagtaaaacaatcaacatgttatagttcatccctctctattccttggctcccaaacttttgggataaagatgtgggtttttaatcttaaaaactggaggctcttggaagtagaaagagctgctgatctctccctgctttgcttttgaactgtctgccttgtgcaagttcaacagtcaaactgttttcattccacttaagtggatctttcttctttgcccacagccttctaaaagcccttctcagtcttctcaggcttttactttaatgctaggatagtctaaatcttcaaggtggctatcccttctcccctccgtggaattcctgatagagtctcaataaaagcaaccttagaaacagaggcttttgagctgaacaagaccctactgctgtcttattcatccattttccaaaccagttttccaaggcaggttttggtagttctgcaaatgttagtgtcaaatttcatttaaaaatattttaaactgtaattttaagatgtatgcttggatgtattgggcagcagcttctaaggtgttgaagattactaaggttggtgcaaaaagtaactgtggttttcgccattaaaaatattaaaaataatggcaaaaactggctgggcacagtggctcacacctgtggtcccagctctttggaaggccgaggcaggtggatcacctgaggtcaggagtttgagaccagcctggacaacatggtga

SEQ ID NO: 157374 - DNA, 8325 bp, Homo sapiens
  Payload ID: 10848
  Gene Symbol: NWD2
  Gene Name: NACHT and WD repeat domain containing 2
  Uniprot ID: Q9ULI1
  ENST ID: ENST00000309447
  CDS Start-End: 849-6077
ggagagatagggatgaagcgatcgtccctccaggacgccagagacaatctggagacttgatgctttaaactctccgggtctggcttggggttgtgtgcgtcgaactttgaggctggattccctgcacttgggcagagacgcacagacgcccgagcgtgtggattcccgaaaattctcagggcttgtgtgacctttaggagagttggagggggcgtagtagaaatctcaggctaattgatttcttgtcctccaccacggaggcagacaggagccctcggctgtccacagaggagtccaggaggctcctgcgcacccccgaggcccccgcgcccaagccccggccgtcctctaagccgcaagttatttctgcgcccgagagaggcgggctcggataaagtcgggacgccttctggtacataaagtttcatctgctctcctcgctcgcacggtccctgccgcctggcggccccctcctcccacggcgggcgcgggcggggagatggccgccggcgcttcccggcgcaaacgggcgctgcgcgcgtagccgccgccacgctgacctcccgctccagctggctgctgctcggagccctagcagcgggcgaaggcggaggcccagaagggcaggagaccgccgcgacaggagcccgagggtccgtatggcttctcctcgccggcgggtgctgtgcgccacggagctcgccaaaggcgcttcgggctcggagcggctctgagccgcgccgcctgctgagatcgaccgcctgctgagccgttccgtggagctgcgggcaggaacccgaggagcaggaggtggcggcggcggcagtggctgttcctcccagagggcgatgtggccggccggcgcgggcaccaagctgccctgtccccgagactctgcgctccggcgggcggctttctctgggaacctcacggccctgccctctcacctcgtgcccgccggccgcagcgtccgggtcttcatcagcgccaaccctgaagatacgggagcagaaagacaggcgctaagagaaaatgtatatcctaaactgagagaattctgcagagaaaactatggattggaatttcaggtcatagatctgtactggggagtggaagaagatgagtgggacagcccagagctccagaagacccgcatgaagctgctggagaattgcttgaaaacttctgcaggtccatgttttgttggactattaggtgaaaaatatgggaatatccgaatccctggagaagttgaagcctcagagtttgaaatgattttggatgccgccatagaggcaaagctggagaccaagttgctggaggagtggtactgtcgagatgagaactcggtgccagcagcctattacctcagacccaagtcagaaatgctgagaagcaatagaaatgcaatgcagccttctaccaatgctgaaaacgagaagacatggcaagagatatcagatgagatcaagaagatatttaaggctgctgtaaagctgttacacgaaaagggtaaaatgaaacacagccaggctaagaggtacctgttctcagctatagaggatgagtttgactttgctctgggaaaacaaactccagcatttctaaagaagtgtgtttgctacattaggaaaattgctaacattgagcgctttgtgaaaatcccagagatgggaaaatacatggatataactggaacagaaccgaggattattcgggacccagaagcccaagagaagctgataaaactcagggatgaatttattcctactattgttgcatcatctaatctgagagtgtacacatctgttactcattgtgacatgaaactaggctactcccaagaaatagaaaatcattacatcgaaggacttggtaaacaattttatgaggacatgattgatataattcaggcaacgatacaacagaattttgacactgaaactgatacactctatgatgaaatccttcaacattcatcattatgtaaaacatacgcctccttctatgagtacaaatgtgaatctctaaacatagtgcataactacattcttccaagcaaagctggacacatcaaccctcttattatatatggtgggccatgcactgggaagacccttctgctagctgaagtagcaaagaaggcttatggctggctacatgaggacacaggaccagaatctgacccagtagtcatcgtgagatttctaggaacgacagacatgagctctgaccttaggactctccttctaagtgtttgtgaacaattggcagttaactaccggtgtctggttcaaagctaccctaagaagatccatgacctctgtgacttatttataaatcttttgaatgagtcttcactgcagagacctctagtcataatattcgatgcactagagcagctctcagagaatgatgatgccaggaagctttggtggctcccagctcacctgccccgctttgtccggatagtcctttccacgctgcccaacaaacatgggatcttgcagaaactaaggtgccttatccatgaagaagacaactacatcgagctgattccccgagacaggaagatgtgcagccaggtcctcaaacaccagctgctgcgcgtcaaaaggaaggtcacatcaggccagcagatttatgtgaacaatgcattatccaagtgcacactgccaatgtttgtgaacctgaccttcagggaggtgaggcactggagatctcacaaagacgtcgatgaatcctccctctctgtcaccgttcatgaaagtatagagcagttattctggtccttggagaagaagtgtggtcagaaactggtctctagggctcttggttacatcaccatggccaaaatgggtctgagtgaaatggaactggaggatgtgttagccctagacaacagtgtaatgagtgagctcaaagaaaacaccagacccagcaatcccctgagagtaccttacttgtacattgcaaggctcaaggagggtctcagtggatacctaatagaaagacatgtgaaaaatgtcacactcctagtctgggccaacagacacctgcagctcatagcccagaagctatatctgcaggatgacaatgacctgcgtgaaatgcacaccatcttagcagattattttctgggggtttggtcagggggcaggaggaaagccttctgccttgaggacccctacttgaatggctgccttgacttggagaacagaagtttgctggaggaagaaaagcacttcatggaacaggcttcctttgacaggcaggctccagaccagccctgggttttccagtgtaatcccctggaacctgacatctttttcgttaatcatcggaaaatgtctgagctgttgtaccacttgacgaggtgtggaaaaaccgatgacctgctttacggcatcatcatgaacttcagctggctttataccatgatcaaaattggccagtttgacaaagtgctttcagacattgagctggcttacaactactcgcaagagaaggagctgaagttcctggccaacaccctccgcagcatcaaaaacaaggtcactgcatttcccggctccctttcagcagagcttcagcaaagactgctgcctgttgtaagctccctgcccaaacttagacatcttcttttagagtgtgataaagatgggcccaaatattgctccattgtaccactgcattcatccatggatgtgacatacagcccagagcgtcttcccttatcatccagtcacctgcatgtcacagagatcctgcctacctgtaaccccagcactgtcctcacagctttagaaaatggttccatcagcacctgggatgtagagactcgacagctactcaggcaaatcaccacagcccagtctgtcatcctgggcatgaaactcaccagtgatgaaaagtaccttgtggtggctacaacaaataacaccttgttgatttatgacaatgtcaattcttgcctcctgtctgaagtagaaatcaaggggaccaagcatggaagcagcgccacctacatcaatggatttacactgtccgccaaccacgcccttgcatggctcgaagccagcaaagatgtcactgtcatcgatctgctgtacggatggccgctttaccagttccactgctggtatgaagtgacgtgcgtccagtgctccctggatggtctgtatgctttctgtggccaatacctgaacacaaccaccatatttcatttagggagtggagaaaagttatgtacagtgacatcagaattttcaggtggatttgtgaagtttcttcttatcttggacacagctcaggaaatggtcatggtagacagtgaaggaagtctttctgtttggaatactgaggacatttccagcccccagctgactgatgactttgattgccgaagagaagacagtgaggtggtcagcattgagctttcagaagaccaaagtgcagttctgatctgtaaagccctcagcattgagctcttagatactggtctgtggaaggtggctgaaaagttcagagccaagcacaacgaacgctttatatctgccgtgctgtctaaaaatggagattgtatcatcgccaccatggaaaatacctcagctgtgtttttttggaggcgggacacaggacagtgtatggcaagcttgcaggaaatctcaggttccattgttaagttagtgaaatccagtcaccacaatatgctactgtctttatcaaccagtggtgttctttccatttgggacatagatataatcacagctatgtccaacatagataagactggaaaacccatccaaagtctgttgttgcctgctagaggggaaatcatttactccctggatggatccgattgtgttcataagtggaacttcagcagtggcttcatcgaagcagtattcaagcatgaaggaatagttgaacactgtgtgttaacatccaccggagatataatggtgacatcagatgacaaaagcagccagtatgtctggcacaccagcagtggtgaaaacctttttcgaattaacgggcagagaatatctcagctgctgattacacacaatgaccagtttgtggtctcgctctgtgaggaaaatgcctccagggtttggaggctcgccacaggccacagggtctgcaacattctgaccactttgcagaatgcctttattacctccgcaaataccttcgtggtgggaatgactaaaagcaaagtgttggcagtcagtctttggacaggaagtatcaccaagaaattttgctgtgaagatgggaccaccatcgtgaattttaaattaatccctgactgtcctgatatcatcgtgtttatcacatcggccgagactgtgaacatctggagtctgacagatgaagtgatctgtcggcgcgtgcaacttccaaacaacttcttgaaaaatctggaggactttgaaatttctcccaatggaaagctaggcattatagccaggggagatgaaaacatcaatgtgctagatttatacagtggtaaattgcgggtggttcacgcctctgggatcatctggcggcagaggttgtctcgggatggtcgctacctggtatacatttgtttccgaaatggggaggaggaggatgaaaatggtgcaatattcagtttaattgtaatgagactggcagatggcaaaaatatcggtgcttgttccctttacaaaacaccaactttccttgcactctcccagaggcacctgaacatcattgtgggctttgatgatgggagtatagggatctacacggtagtagaccgtgtagatgctgcactgaaaatcaaaattgccacttcaaatagcagacaaattttcaacaatgcaacacacacctccaggccaaagtgtaacagttattgttttaaaatatctgtggattgcttatggagagagtccactgaggtctttgcaagagacagccccatcacagttagtgactctactgagtccaatgaagcaacaccctccaagaaacacaactcttgttatgagcgggtatgctcggccctagaagccaggggccacagctatgcccctgataactgacaaaatgttttccagctaagcagaaatatgtgatccacgtacagaagggaaaaaaatgtgccccaaatgataaactattcatttattaaaaggcaggagcgatgctggaattccagtgttttattaagatgttcatgaaatggacaaataggttagtcttgggtgtggtctttttgtcaaagtgtatccagaatgtcagaatttctagtagtaatatttaaatggttacttcatctgaaaggcagaggctaaaagtttttaaattagctgtgtggtgaggcagcataatacatcccactggttaagatgagagaggctagagttatatacagatcatttggatgggaattagttctacaaaaatcagctgaaatcatgaagacaaagagctgcttgacttcaaatgattgtgtgataagtaaacacagccttaatctctctttacattttacagtcctgacaactgtgtacacctagtctgcagtgaacggtctaaaggtgcaaaatatgtaacaaaaatacccaagtgtattcccagtttcccgagagatatgacctgaaacatgagactgtggactggactgggacaagaactaactaccactatcatagggctactgaacatggagagtcagtctttattaaaagacagttgcaacaattgcatgcgagggtttctgtataacagaatatatgatttttaaactatttcctgggttgcaaaagaacacatttagtaagaaacaacaatcttttcgcatctttttgaaatgcatatttgtgctgggtgtaaagaagattacaggaagggcattacaaatctggtcaaaacacctgtccatttccatcattgtactaacagaagtctgtactatttggtcagtttgtatggaagcataaatattccctaaattcctgcagttagtcttcatagaaagcaagctttctcaacatgccatctctgagatactgatgacgtttgccttactcacattccttctctttcctgtgtaaaatgcagatagatgaccaaatactctgggataaactgaatatgcctgtctttgtgctaaaatattccataaatcttaagggtgtccaaaagttctttattgtccttgtttgtaatcactttcttacttctacacaccatctgtatgcttctttatctgttactcttcctgattgaggactcttctgagccttttatagtcctatccatttcaaagcagaagctgtggaatggtattaaatattttttaaaattaattcacctgtttaaaagaaaacattgcatctcaaaaggtgaagatgattgttctttcttccatatcctccttacggcatgtccttggataacttttcaaaaggtatccacacttttggttgagtttagttttcttagaaagtagagaagtaacactttactagaataatgaacaaggaattgatttgctctaggcccagctctgccataaactcattgtgtattcctagacaggtctttaacttcatcagtgtgttgtttttgtgaagtgcaaaataaagatagtgatagtttctgctgtagccctcatagggacattgggaagcagtataagaaaaacttcagcaacatcatgattattgatgctaataggaaaaataaattcatgtaacccatagagaatccaggtcaattgtatttcctcttggaaagcagtttaacatgtaagcgttcaaagatgtgattcagataaaaatacccaggtccatagtgaaagatgtttttcagtatgttacttatggtttagctactagccagggaggtggtagcccagagaaggcaaaccacatacagatcacctggagttgattatatgagtctatgcttttgagctctttaggcaacacattctcattcctgtcattatcagttgaacctccatgccacacatttctaagaattaaatgcctagatggattaaatgtagtatgtgaatgttctatgtaaaagccaatagagtatacaagtgacttgaatgatttttcctaacttgtttgcaactgatagctcatattgaatgtttttatgtaaactttgtatcgttgggaagaattacccaatcagagatttatattttcataaatgttacatttagttaaattttgttacagagttgttacactagaaaattatttcagtcttcaaacaatatacagtcttgtgtatgtattatttgtatgaataaaagataaactacttaga

SEQ ID NO: 157375 - DNA, 4972 bp, Homo sapiens
  Payload ID: 10849
  Gene Symbol: NAPEPLD
  Gene Name: N-acyl phosphatidylethanolamine phospholipase D
  Uniprot ID: Q6IQ20
  ENST ID: ENST00000341533
  CDS Start-End: 439-1620
cccgcggcccgggatcccgagtgtccggagctccgtggtttctgttggacctcgcgggaggcggttttctcccgcctgctgtgctctgtgacctctctgctgcctcctccacggtctctgggcggagcaatccacactgctgagcctggggtggtttggaattcttcggcgaagtggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaataatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaaaaaaaaagaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgtggtgccacgttagccactaaatctgaacttttaccctgctttcatcatggatttttttgtgtaacctgaaacaagtcaccagtgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctcttcgtgaatacccatagcaatatgtaagattttattgaagtttcctgtgataactgaggaatactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaaccgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaagggaaaaaata

SEQ ID NO: 157376 - DNA, 1822 bp, Homo sapiens
  Payload ID: 10849
  Gene Symbol: NAPEPLD
  Gene Name: N-acyl phosphatidylethanolamine phospholipase D
  Uniprot ID: Q6IQ20
  ENST ID: ENST00000427257
  CDS Start-End: 299-1480
gaaggaggccaccgctggccctgctgtcagattcgaaggtcataataagggagtgacccggcgacgactcgccccaacgatggcgaggcggcgagagctgaagcgctgcctgcagctgctggcgtcctcggcggagccagcgcggcgggctcgggttaggaagaacccgagcgcctgccgcggtcgcccctcccgctacgcggcggcgctttgcgcggggactctgtggccggaagccgcggaactgaggcggcgcgcgctcccggccaccccaagcgcgagttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattca

SEQ ID NO: 157377 - DNA, 658 bp, Homo sapiens
  Payload ID: 10849
  Gene Symbol: NAPEPLD
  Gene Name: N-acyl phosphatidylethanolamine phospholipase D
  ENST ID: ENST00000420631
  CDS Start-End: 1-431
cccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaataatttcctgaggtgaaaaaccgatattgaagattcatttttcttttttccattcttcaggaccttcggcaagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcgg

SEQ ID NO: 157378 - DNA, 565 bp, Homo sapiens
  Payload ID: 10849
  Gene Symbol: NAPEPLD
  Gene Name: N-acyl phosphatidylethanolamine phospholipase D
  ENST ID: ENST00000418294
  CDS Start-End: 194-565
acactgctgagcctggggtggtttggaattcttcggcgaagtggagcgggctgagagtgggtttcccgtccccgagccctccctcatctcggagatgccgcacttgtgagcgacagggcttcatttgaattttcgcacctcgcgagttgcggagcctgcatctctgaagctgcctcgttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggc

SEQ ID NO: 157379 - DNA, 4988 bp, Homo sapiens
  Payload ID: 10849
  Gene Symbol: NAPEPLD
  Gene Name: N-acyl phosphatidylethanolamine phospholipase D
  Uniprot ID: Q6IQ20
  ENST ID: ENST00000417955
  CDS Start-End: 156-1337
ctcgcgggaggcggttttctcccgcctgctgtgctctgtgacctctctgctgcctcctccacggtctctgggcggagcaatccacactgctgagcctggggtggtttggaattcttcggcgaagtggagcgggctgagattcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaaaaaaaaagaaaaaagaaaaagccgggtgaggtggtgtgtacctgtagtcacaggtacttgggaggctgaggtgggaggatcacttgagcccaggagatagaggctgcagtgagctgtgatcgtaccactgcactccagcctgggcgacaaaatgagaccctgtctcaaaagaaagccctctccttagctgagcagaggaagggaaggagtgtggctatgagaatatgatttatgccattttctgtttttaaatctagaagatcttctaagcacaaatacagctacaatgaaatattttacagacaaaatgttaatagaccatattctttgaattaaatttgtttttaattttctctacacattttttttttcctggagtctcttagctctaaatatatcaatcagatttataattttttttacctgattcagatgtcttacatttttatattaaatgaaccttaagcatgattcttttggtaagccagtatgaatgccagtggttggggggcggggggggagtcagttgacataagatttagtcctaataaggactctgtattcacttgattattctgacccttcctaagggagggaggtggattagataccactggaggcccattctgtattcctaatccagtctcagcactttattcatacaaaataatcaaaataggttttctacaccaaatgctacccaggcagtgctctataatttatttgcacacctgtatgtgtggtgccacgttagccactaaatctgaacttttaccctgctttcatcatggatttttttgtgtaacctgaaacaagtcaccagtgctcactgtgcctgtttcctcatttgcaacaagaggataattccgacctacctctgaaaaatgtgtagattaaatgagtttttaaagcactttagaaaatataagggagaaaatgatttcttaagatatcactgcctaatatagacaggtatatttgaaagctaaatacaggttaatgcttttgataatgtattgttcctgttgcaaatttaagcattatatattaggagactaaacattgaaaactttcactgatttttaaattggagtaatagcctaaataagtgtaaataatctttatcaaaatttagtgtttatctacaaagatgcgaatcagtcaaggggaaatgtgtatgcaatgtgtgtgtatatgatgtatgcgaacatatgtgattttggggtactaaagcacaaaaaaatcccccataaaataaaccttcctgaaaagactgatcataaactttttcactccaagcagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctcttcgtgaatacccatagcaatatgtaagattttattgaagtttcctgtgataactgaggaatactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaaccgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagatgtatcaataaattgttatagtagcttatggaaaatgctattaaagataaattttcatacattgtatttttagtcaagtaaaatatggatgaaaattaataaagtactgtcaagggaaaaaa

SEQ ID NO: 157380 - DNA, 2672 bp, Homo sapiens
  Payload ID: 10849
  Gene Symbol: NAPEPLD
  Gene Name: N-acyl phosphatidylethanolamine phospholipase D
  Uniprot ID: Q6IQ20
  ENST ID: ENST00000422589
  CDS Start-End: 95-1276
ggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaataatttcctgaggtgaaaaaccgatattgaagattcatttttcttttttccattcttcaggaccttcggcaagatgtgaatcaagatgttaggtttatggtgagttagctttgaggtgtgttgccctaatactagccagcgttgttgtagccatattccctgctgctgcacgccgaattgaaaatccatctcttacctcttctctatgaagcaagccaggtatgtcttgcttaagtatttcttctccatgaatggccttaacattattttgtattcacgtgtactgtttaactgagggtctcaaagcactttaaactgttgtgttctatttccactcgtctggcctgcctcatttttctaggcccttttgtaagctgtaattttttattaccactcatgttctttctacactgacactattcattaagaacatcaagcttcatctctgcttacagaatctcaccttattgagtgggttccactttatttttcatttgttatctacattttgaagggtttatgtgcaaagtgaaaacaaattttgaaaaataagacaaatccattctcttcttcaattcagtctaatatgcattgtagtgtcttttaatcagtcttatcctctaagtcaacttcattttcctcttcgtgaatacccatagcaatatgtaagattttattgaagtttcctgtgataactgaggaatactttgctatgcctcactgcccaatagggtgggtcatcaattaggagaaatcccaaattataaaagccaacatatgccgtgacctacgtaggaaaagatgtatttgtgcatcttctttctgggtagttaaaaattactccctcttttctctagcattttgacatttcagactcaatgctctgatctctagggagtgtgattattcaaactaatgagaggacaagaagacacagttttagaatctactgctgctaaagcacattaaaaacaaatcctggtttttaatgtatgcatagtttcatatttaatgaatatgctttcattaaatagggaggtagatttgaaaaaaccgttataaagaaatgtgccttttggggaatgaatacttttgttcatgtctagcccactgggaattttgttttcaccttatactgagtcctttttctaatgtaaaaatatttcttccaagtttgatttctgtatcagggtaacattgagaacacacatatttctgtttgaggatttgtgacttcctatggaaacagtcttgcatctatgtatttacaaatgaaatttaaagtattcttaaagctttgccttaaatactgcttgcatactgatttacttaatgctaagcatggcaggggttataaatttaaatactataagacctggctgaatcccagat

SEQ ID NO: 157381 - DNA, 575 bp, Homo sapiens
  Payload ID: 10849
  Gene Symbol: NAPEPLD
  Gene Name: N-acyl phosphatidylethanolamine phospholipase D
  ENST ID: ENST00000425379
  CDS Start-End: 559-575
gcgcccgcggcccgggatcccgagtgtccggagctccgtggtttctgttggacctcgcgggaggcggttttctcccgcctgctgtgctctgtgacctctctgctgcctcctccacggtctctgggcggagcaatccacactgctgagcctggggtggtttggaattcttcggcgaagtggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccagttacattggttatgaattagccgcagacatggacatcgtttagaaagaagttatgtaatctttaaaaagaagattacctatatcccacaatagtgtgatttttgttgcaagaaaatactgggtctgttaaagaagaaatttaggttcttcaccaaaggacatggatgaaaatgaaag

SEQ ID NO: 157382 - DNA, 2380 bp, Homo sapiens
  Payload ID: 10849
  Gene Symbol: NAPEPLD
  Gene Name: N-acyl phosphatidylethanolamine phospholipase D
  Uniprot ID: Q6IQ20
  ENST ID: ENST00000465647
  CDS Start-End: 280-1461
aattcttcggcgaagtggagcgggctgagagtgggtttcccgtccccgagccctccctcatctcggagatgccgcacttgtgagcgacagggcttcatttgaattttcgcacctcgcgagttgcggagcctgcatctctgaagctgcctcggtgaagagccacagcattattttttttctctttgggagagtagctgtctgggatttgagatcctatcttccctgcaaattaccaggttgcatcttcactgataggaatacatttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattcatttttcttttttccattcttcaggaccttcggcaaggtgagtcaaggctctctacctacctagatgtttttcagaggcctacaaatacaagtatctttcttatatgcacattctaataaatgatgaaattcagtccaacatgcttattataaacatagcaattcttgctctatcaaattagcttatatgccaaatattaaatatggtttatttaggtaagcataaaaacataggggctatcatttttaaagacttgattttctctattgtggtaaaatatataaatacatatttgccattttaaacatttaccattttaaccatttttaagtgtacagttctttcgcattaatgcacccatgaccaccattcacttaaatttttaaaagaacagtatattctttttttcctagagccttcagatgagagggaacagtatattctattgcacgtctacaattcccaaaagacctcttactttgggaggccaaggtgggtgggtcacttgaacccaggagtttgacatcaacctgggcaacatggtgacctcccgtctctctcggaaaaaaaaaaagaa

SEQ ID NO: 157383 - DNA, 4988 bp, Homo sapiens; identical to SEQ ID NO: 157379
  Payload ID: 10849
  Gene Symbol: NAPEPLD
  Gene Name: N-acyl phosphatidylethanolamine phospholipase D
  Uniprot ID: Q6IQ20
  ENST ID: ENST00000622712
  CDS Start-End: 156-1337

SEQ ID NO: 157384 - DNA, 4972 bp, Homo sapiens; identical to SEQ ID NO: 157375
  Payload ID: 10849
  Gene Symbol: NAPEPLD
  Gene Name: N-acyl phosphatidylethanolamine phospholipase D
  Uniprot ID: Q6IQ20
  ENST ID: ENST00000611100
  CDS Start-End: 439-1620

SEQ ID NO: 157385 - DNA, 1822 bp, Homo sapiens
  Payload ID: 10849
  Gene Symbol: NAPEPLD
  Gene Name: N-acyl phosphatidylethanolamine phospholipase D
  Uniprot ID: Q6IQ20
  ENST ID: ENST00000633783
  CDS Start-End: 299-1480
gaaggaggccaccgctggccctgctgtcagattcgaaggtcataataagggagtgacccggcgacgactcgccccaacgatggcgaggcggcgagagctgaagcgctgcctgcagctgctggcgtcctcggcggagccagcgcggcgggctcgggttaggaagaacccgagctcctgccgcggtcgcccctcccgctacgcggcggcgctttgcgcggggactctgtggccggaagccgcggaactgaggcggcgcgcgctcccggccaccccaagcgcgagttcttcaccaaaggacatggatgaaaatgaaagcaaccagtctctgatgacaagcagccaatatcctaaagaagcagtaagaaaacgtcaaaattcagcacggaattccggagcaagtgattcttctaggttttctaggaaaagcttcaaactggattatagactagaagaagatgtaactaaatccaagaaaggaaaagatgggagatttgtgaatccgtggccaacatggaaaaacccctctattccaaatgttctcagatggctgataatggagaaagatcacagcagtgttccaagttctaaagaggaactagacaaagaactcccagtgcttaagccatattttatcactaaccctgaagaagctggagtgagggaagctggcttaagagtcacatggctgggacatgccacggtaatggtggaaatggatgagctcatatttctcacggatcccatctttagctctcgtgcttcaccatcgcagtacatgggtccaaagcgatttcgtcgttccccgtgcacaataagtgaactccctccaatagatgcggtccttatcagtcacaaccactatgaccatctggactacaattctgtcattgctttgaatgagcgatttggtaatgagttgagatggtttgtgcctttgggtctccttgactggatgcaaaaatgtggctgtgagaatgtgattgagttggactggtgggaggagaattgtgtccccggacatgataaggtcacttttgtctttacaccttcccagcactggtgtaaaaggactctaatggatgacaacaaggtgctatggggcagctggtctgtcttggggccttggaatcgattttttttcgcaggagatactggttattgccctgcttttgaagagataggaaaaagatttggaccttttgaccttgcagctattcccatcggagcttatgaaccgaggtggtttatgaaataccagcatgtagacccagaagaagctgtaaggattcacactgatgtccaaacaaagaaatctatggcaattcactggggaacttttgccttagcaaatgagcattacttagagcctccagtgaagctgaatgaagctctagagagatacggacttaacgctgaagatttttttgtcttgaagcatggagaatcaagatacctaaataatgatgatgaaaacttttaataaatgtgagcacaggcacttttaatgaaaaaggcatcatctaagtttaaaaacaaatgaaaagacttagaaattcatgaatattgtgattattttacatttggaaacaacttctgcaagtttatgttttatgttttgtgtaataacttgcttcctagtatgatcagctcatgtacactatgagagggttcaggggtgggtcatttaaataatgaattggctaatgtggattttaaatttcatatcatgatataagcactgcaatggaaatgtttttactaaaacattatatttttgtggtactagaatttcctgaggtgaaaaaccgatattgaagattca

SEQ ID NO: 157386 - DNA, 658 bp, Homo sapiens; identical to SEQ ID NO: 157377
  Payload ID: 10849
  Gene Symbol: NAPEPLD
  Gene Name: N-acyl phosphatidylethanolamine phospholipase D
  ENST ID: ENST00000633771
  CDS Start-End: 1-431

SEQ ID NO: 157387 - DNA, 565 bp, Homo sapiens; identical to SEQ ID NO: 157378
  Payload ID: 10849
  Gene Symbol: NAPEPLD
  Gene Name: N-acyl phosphatidylethanolamine phospholipase D
  ENST ID: ENST00000633498
  CDS Start-End: 194-565

SEQ ID NO: 157388 - DNA, 2380 bp, Homo sapiens; identical to SEQ ID NO: 157382
  Payload ID: 10849
  Gene Symbol: NAPEPLD
  Gene Name: N-acyl phosphatidylethanolamine phospholipase D
  Uniprot ID: Q6IQ20
  ENST ID: ENST00000632159
  CDS Start-End: 280-1461

SEQ ID NO: 157389 - DNA, 2672 bp, Homo sapiens; identical to SEQ ID NO: 157380
  Payload ID: 10849
  Gene Symbol: NAPEPLD
  Gene Name: N-acyl phosphatidylethanolamine phospholipase D
  Uniprot ID: Q6IQ20
  ENST ID: ENST00000632703
  CDS Start-End: 95-1276

SEQ ID NO: 157390 - DNA, 575 bp, Homo sapiens; identical to SEQ ID NO: 157381
  Payload ID: 10849
  Gene Symbol: NAPEPLD
  Gene Name: N-acyl phosphatidylethanolamine phospholipase D
  ENST ID: ENST00000633315
  CDS Start-End: 559-575

SEQ ID NO: 157391 - DNA, 1900 bp, Homo sapiens
  Payload ID: 10850
  Gene Symbol: NAAA
  Gene Name: N-acylethanolamine acid amidase
  Uniprot ID: Q02083
  ENST ID: ENST00000286733
  CDS Start-End: 103-1182
tccagcgatcgcagcccagccccagctcctcctcctccacggcttacccgggctccgacagcggctgcaggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagattttgtcggtggttccagtttataacaacttcacaatttatactacggtaatgagcgccggtagcccagacaagtacatgactaggatcagaaacccgagtagaaagtaagtcagcagaagagcgagttcgcccgtgctgtgaaagatgattttttaaaaaatgaaattcttgaagagctgcaccttaaaaaataagacaaagtgaaagtattgtattatgttacaaacaatgcaggctccttcctcatttaactttacaaccttgcgaagtgggtccaggagatttggagtttgtggtaaagccagtaatgggcattgtcctgcattcccttcccttcatggtttgcctcgatcctctctaagcttctatcctggcctgaataactcaaagataattggtctcagagatcaagccatatcctcaggccttatttccatcttctcatgattctgccatcatacctttgcttctccgctaatgaaatgagctggcaagacctctgttcattgtgaagtgcttctgaaagagcctaagaaaaaaggctcatctgaaagaaatggagaactctatttcgaaccaagcctgtttgaatgtgtgttagtctgatctttgatcatgtgtttccatgtaatgggagtctcgttttttataatgtttctaacgttttattgaaaaacctatggccctccttctttctcaatagctactttcttactgctttttgaaaataatatgcaaccaaattatttcttaatgtcacataattaagtaataaaatgtcaaaagaaatgttggcaaggagaataaaaaaatttccaagaaactt

SEQ ID NO: 157392 - DNA, 1750 bp, Homo sapiens
  Payload ID: 10850
  Gene Symbol: NAAA
  Gene Name: N-acylethanolamine acid amidase
  ENST ID: ENST00000507187
  CDS Start-End: 35-538
aggtctccaagttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcaggtataatccgtaccatataagataaaaaatcagaaagatttgcaaactcaagttagcagtcatttggatggcctgctaacttaagtgtgttatcagtgtaagacacaaaaaaatcacacccctggaaaaacaaagccagaagagaggtttgcatcaattatgcttataggaaggacggtcatttattatttattattcagtgtctacttaaagaggtcacccagttttccatagggaaatctcttttagagagtgatcaatcatccacttatgcagagtcagctctttcctctgctttcccatgcccaggctgcttctggaatatggaggggctgggtagtgcaataactagaaacacccaactttgggatctgacagtcccaggtttaaatcttgattctatcaattactgtacttcctttgtgaacctgagaaattactcattccctaattttgcagactacagctcatggaggctcataactactttactgcgatagttataaatgttaaatgaagtagtctatgtaaagttgtagccaaataataaatggtccttcattctgcaagtgtgattgacccacaccactttcttgtgtatgatctttaaaaaattatacttagatcttttgtttatagcatggtccctttaaaactataatctagtgtgtgctgttgtcaactgtgtaaacttttagagagacagaattaatcaatgttcattgagtacgcaaagcatgttttgctgtaaaacagaatacagagtgcaaaagccagattttggctgtaaggacaaggactatattccctttgttctttgcatttaggggttgattcacaaatactaaaaactcatttactaactactcagtcatctgcttttacaaacactttttttcataaaaaattcaaacagtacagaaatatttaaagtaaaagtttctcctttccagtcccatttctttactttgccactattaacaatttgatttctagctgaattactttaaaaatgattttaagtggtaacgataatataaatgcataataaattctcaaaggaaatctgctaaatattaagttattactgaatgaaggataatattatttattatttattcatgttttttctccattgttctataatgagctaatactcttaataaagagacaaaggaataaatgcaatgaaaataaattatttcagctgctctgaaa

SEQ ID NO: 157393 - DNA, 534 bp, Homo sapiens
  Payload ID: 10850
  Gene Symbol: NAAA
  Gene Name: N-acylethanolamine acid amidase
  ENST ID: ENST00000513045
  CDS Start-End: 1-418
agataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagcttcacaatttatactacggtaatgagcgccggtagcccagacaagtacatgactaggatcagaaacccgagtagaaagtaagtcagcagaagagcgagttcgcccgtgctgtgaaagatgattttttaaaaaatgaaattcttgaagagct

SEQ ID NO: 157394 - DNA, 1425 bp, Homo sapiens
  Payload ID: 10850
  Gene Symbol: NAAA
  Gene Name: N-acylethanolamine acid amidase
  ENST ID: ENST00000505594
  CDS Start-End: 193-951
acgccctaaggatgtagccccgctcgcagtgcacacgcagtcgcacgccgccgacctctgagcgggtcagacgcccttgtgctttttgtttctagggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccaggtaacttgtgtcacagtgtcctgcatacctaggatgtttggtgttttgttaatagtgaatatgaaaaactccgtgaaatcttctggtagatgaaaacgttagggtaaaagttttatttggttgaaatcatgtattaaaagtggtggctcacacctgtaatcccagcactttgggaggcctaggcaggcagatcacgaggtcaggagattgagacaatcctggctaacacagtgaaaccctgtctctactaaaaatacaaaaaattagccaggtgtagtggcgggtgcctgtagtccaagctactccagaggctgaggcaggagaatggcgtgtacccggaaggcggagcttgcagtgagccgagattgcgccactgcactccagcctgacagagcgagactccgtctcaaaaaaaaaaaaaattatatgacattttctcaacttgcttttatataagttaaaatgtccatcttcaccaaagtttttctttatattaaaaagaaaaagtcatagttgtaatatatgttcattgtttaaaagaaaaaaagagaaagaattaaaaagtca

SEQ ID NO: 157395 - DNA, 1300 bp, Homo sapiens
  Payload ID: 10850
  Gene Symbol: NAAA
  Gene Name: N-acylethanolamine acid amidase
  Uniprot ID: Q02083
  ENST ID: ENST00000507956
  CDS Start-End: 25-996
gttgcggccgctggagcccgagccatgcggaccgcggaccgggaggcgcgcccggggcttccgtccctgctgctgctgctgctggccggggccgggctgtcagccgcctcgcccccagcagcgccgcgcttcaacgtgagcctggactcggtccccgagctgcgctggctgcccgtgctgcggcactacgacttggacttggtgcgcgccgcgatggcgcaagtcatcggggacagagtccccaagtgggtgcacgtgttaatcggaaaagtggtcctggagctggagcgcttcctgccccagcccttcaccggcgagatccgcggcatgtgtgacttcatgaacctcagcctggcggactgccttctggtcaacctggcctacgagtcctccgtgttctgcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagtgaaagcaggccaggtgcggtggctcacgcctgtaatcccagccctttgggaggccaaggcgggtggatcacttgaggtcaggagttcaagaccagcctggccaacatggtgaaacctcgtctctactaaaaatacaaaaatcaaccaggcatgacggtgcacgcctgttatcacagctacttgggaagcagcggctggagaattgcttgaacctgggaagtcgaggctgcaagtgagctgagatcatgccatggcagtctagcctgggcaacagagcgagactctgtttcaaaaaaaaaaagaaaa

SEQ ID NO: 157396 - DNA, 734 bp, Homo sapiens
  Payload ID: 10850
  Gene Symbol: NAAA
  Gene Name: N-acylethanolamine acid amidase
  ENST ID: ENST00000602782
  CDS Start-End: 1-668
gcaccagtattgtggctcaagactccagaggccacatttaccatggtcggaatttggattatccttttgggaatgtcttacgcaagctgacagtggatgtgcaattcttaaagaatgggcagattgcattcacaggaactacttttattggctatgtaggattatggactggccagagcccacacaagtttacagtttctggtgatgaacgagataaaggctggtggtgggagaatgctatcgctgccctgtttcggagacacattcccgtcagctggctgatccgcgctaccctgagtgagtcggaaaacttcgaagcagctgttggcaagttggccaagactccccttattgctgatgtttattacattgttggtggcacgtccccccgggagggggtggtcatcacgaggaacagagatggcccagcagacatttggcctctagatcctttgaatggagcgtggttccgagttgagacaaattacgaccactggaagccagcacccaaggaagatgaccggagaacatctgccatcaaggcccttaatgctacaggacaagcaaacctcagcctggaggcacttttccagattttgtcggtggttccagtttataacaaattatttcccttggctgaattcccagaagtaggattactgagttaacagttatgaatgtttaaatggtttctgaaatggtttggtcaaaataaaattgttagaaattataaa

SEQ ID NO: 157397 - DNA, 2609 bp, Homo sapiens
  Payload ID: 10851
  Gene Symbol: ASAH1
  Gene Name: N-acylsphingosine amidohydrolase (acid ceramidase) 1
  Uniprot ID: Q13510
  ENST ID: ENST00000262097
  CDS Start-End: 313-1500
ggctcggtccgactattgcccgcggtgggggagggggatggatcacgccacgcgccaaaggcgatcgcgactctccttctgcaggtagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccagtgctaaaggttatagtgaattctctgaagaatatgataaatacattcgtgccaagtggaaaaattatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgtcatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgat

SEQ ID NO: 157398 - DNA, 1690 bp, Homo sapiens
  Payload ID: 10851
  Gene Symbol: ASAH1
  Gene Name: N-acylsphingosine amidohydrolase (acid ceramidase) 1
  Uniprot ID: Q13510
  ENST ID: ENST00000314146
  CDS Start-End: 185-1354
gggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaactgtcttccctgctgttataaggtacagaggtgcagttccatggtacaccataaatcttgacttaccaccctacaaaagatggcatgaattgatgcttgacaaggcaccagtgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgtcatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtg

SEQ ID NO: 157399 - DNA, 2511 bp, Homo sapiens
  Payload ID: 10851
  Gene Symbol: ASAH1
  Gene Name: N-acylsphingosine amidohydrolase (acid ceramidase) 1
  Uniprot ID: Q13510
  ENST ID: ENST00000381733
  CDS Start-End: 168-1403
ggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccagtgctaaaggttatagtgaattctctgaagaatatgataaatacattcgtgccaagtggaaaaattatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgtcatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctga

SEQ ID NO: 157400 - DNA, 2507 bp, Homo sapiens
  Payload ID: 10851
  Gene Symbol: ASAH1
  Gene Name: N-acylsphingosine amidohydrolase (acid ceramidase) 1
  ENST ID: ENST00000520781
  CDS Start-End: 313-1425
ggctcggtccgactattgcccgcggtgggggagggggatggatcacgccacgcgccaaaggcgatcgcgactctccttctgcaggtagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccagtgctaaaggttatagtgaattctctgaagaatatgataaatacattcgtgccaagtggaaaaattatgcaggtggtggatgaaaaattgcctggcctacttggcaactttcctggcccttttgaagaggaaatgaagggtattgccgctgttactgatatacctttaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgtcatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagag

SEQ ID NO: 157401 - DNA, 2184 bp, Homo sapiens
  Payload ID: 10852
  Gene Symbol: ASAH2
  Gene Name: N-acylsphingosine amidohydrolase (non-lysosomal ceramidase) 2
  ENST ID: ENST00000329428
  CDS Start-End: 1-2181
atgagtgccatcacagtggcccttctcagcctcttgtttatcaccagtgggaccattgaaaaccacaaagatttaggaggccattttttttcaaccacccaaagccctccagccacccagggctccacagctgcccaacgctccacagccacccagcattccacagccacccagagctccacagccactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcacaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaagtcaaaaacatgtaaaccagcattgggctacagttttgcagctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtga

SEQ ID NO: 157402 - DNA, 6880 bp, Homo sapiens
  Payload ID: 10852
  Gene Symbol: ASAH2
  Gene Name: N-acylsphingosine amidohydrolase (non-lysosomal ceramidase) 2
  Uniprot ID: Q9NR71
  ENST ID: ENST00000395526
  CDS Start-End: 1-2343
atggccaaacgcaccttctctaacttggagacattcctgattttcctccttgtaatgatgagtgccatcacagtggcccttctcagcctcttgtttatcaccagtgggaccattgaaaaccacaaagatttaggaggccattttttttcaaccacccaaagccctccagccacccagggctccacagctgcccaacgctccacagccacccagcattccacagccacccagagctccacagccactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcacaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaaggaactctatgcctctgcctcccaggaggtaacaggaccactggcttcagcacaccagtgggtggatatgacagatgtgactgtctggctcaattccacacatgcatcaaaaacatgtaaaccagcattgggctacagttttgcagctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtgtgtgtgtgagagagagagagagagagagagagagagagagaggtttgtcccatatatcttgctccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgttttcctaagtgtccttatcccactggattgtgtctcttactcccaagacttattccaaatgattttttgactcttttcattaatcaaattcaccccaaaccagaaagttttgccattagtgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaagcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacagtctgacatcgattgtctgaaagtactaattgcatttaaaattctttaagttaactacaacctcccagactgcaaagcaaatttccaaaccccaggtcatacttttgtatgtatgtaaaagctttagcattttagggaaaaaaatcaatctgtattttaaaaataaactttgaggtttgaaaataataacaatattcataatggtagtattaacatctattatgtataacttaatctcaacataatttattgaattagaatgaacctggaacactttttgatgaattggtatcctagaggctgtttccttgggcattaactgctggaggattaggtaatcagggattccaagtgttgtgatcttttttctgatgatgccacagtcttcagtgtaaaagttcagaagcctaaaagaacaagtgatcctgaaagtagctgattccagacaagaaaattatattagaacttatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatcctactgcacctagcactcttggctccagataacgcacagaaacctattttctcaccagctgtcatttcttctagggcatgcagttctatgttcgcagttcatgtgtaaaaataaaaccaaattcctggattatcaatatcagttctttacctgtgcataaaagaatatcatgaagtaattgaacttatctgttgatataaaaacacagatccaattcatgtctgtggatgctgcagggactggctcactggagccaaaccatgtggcagaaactcctgaaattggtggaaaaagtggaatatggcagattgggtaggtaggagaacaattttggagattttgtttctcatgttaaaatgtctgcattttatttgctgtaccctgcctactctggttttaaggattttttgacttctttgaaaagcactgaataatctcttttccaggtctagattttttgatgagtactgtgtaaaattgtcaatattcaatggattatttaataataaattaagaattacactcataaaagtattgtctaatgaaaggtaatgtagacaaacgaacacttttttaaaaaaagaggtggaacaaaaggtggtagattacatgtaagttaggttggaaagtgatacaaatgacttgtaaataaccactgaagcacaagggaaccacttctttatcagttcctttctaacttctgaagatgtactgctggtaaaacacatgtatggttgacaattcttttattttctttctcttttttactagttgggcaaaaaaatttcctaggcaggtagctaactatgaaattgtttcatgcgctaattctgaacaaaaagaccaagaatgaatttacttatgaatgtccttttctaatgtgccctcttatgcttctcctccaatgtaagcaagcttactgtctttttctaagattagcgcatggattctatctttagccaaaaggtttcatcactagatgaacttctcatgtgtttagttcttccaaatgatgctcttgcttcctgggtatccaacctgacttgctggtttatattggcttccaaaattttagagtgatagggtatcggagagggaaatttgcacattccttatgcaatttgttagtatgcattcagctgtaactcagaaaatattcctgatcaacatccatccaaacactaaagacatttataacctcacatagcagtaagtcttgaagtgataaattcaggtttggtgcagccactcagtggctcttcttaatatattgacttaattcttaggcttatcctcttagctaaaagatcgctacctcaagtctacatataattgaatgcagcagcaaaatgggaggagagagttctctttataatccccttttagaaggtggaaaatagtaagaacacaagttgaattttccttctatttctttgttcagaactgtgccacacagctactcttacctgcaagggaagctggaaaaaagaatatttagtattttgtgcttctagagagtgaggcaagttctgatagtaagaaagaagagatagccgaagtagctgtcataaaattatgttagtcaagacagattagttatgctacaacattagagatttatttcttgatctcatgacctgtccattggggttagctgaaggatctgttccacatctcatttgagttcacaggctgacagagacttccattctaaacattcttccattgtgagggaacaggaacaggtgcttccatgattagggggaagggacagggagaatcatgcaatagttcgtgaagcttccacattactgtgcatttttcactgggcaggtgacagaaccaggatatttgcaagcagccctaaaggttaccacagtgggcaagcaataatatctgcatatccaaattaactgctctttgaaataattagaactcgttttactctagaaaatatattttggaaaagaacacacattggaataatgacgaaaaaaattgctttctgtattgcaaaatgtatacgttactttaacagatttatatcaagcacctatatactttatggcagaaattatgctaaatcctaagaatgaaacaataatgaaggcaaagctattccctgccaaaaggaacttagcgtttaacgaacaaagcaaacagatgaacaggtaattactgtacagagtgacccatattgttattgttcagggaattagagagggcacctaatatggtcttggggatgtttcagtaagtttcctggaagaaataacatataagctaagacttaaaagacatgtagaaattagctagaagaaaggcaatggtgtgtgcatgtatgtgtgtattagtgtgtgtttgtgtttgtgtactgggcaaatagactattccatgtagagggaatattgagtactttatcaagactatagttagagtataaggaaagagttgacagtgaggcagcaccaaactttaccttcataaatagcaatttggttttatacttgtattagcatttttcccccttgagactcttcccctataacatcaatgtccttgaatgtatttgccatttgctctaataataaaatacactttctataaccaaaaa

SEQ ID NO: 157403 - DNA, 2311 bp, Homo sapiens
  Payload ID: 10852
  Gene Symbol: ASAH2
  Gene Name: N-acylsphingosine amidohydrolase (non-lysosomal ceramidase) 2
  Uniprot ID: Q9NR71
  ENST ID: ENST00000447815
  CDS Start-End: 1-2238
atggccaaacgcaccttctctaacttggagacattcctgattttcctccttgtaatgatgagtgccatcacagtggcccttctcagcctcttgtttatcaccagtgggaccattgaaaaccacaaagatttaggaggccattttttttcaaccacccaaagccctccagccacccagggctccacagctgcccaacgctccacagccacccagcattccacagccacccagagctccacagccactcaaacttctccagtgcctttaaccccagagtctcctctatttcagaacttcagtggctaccatattggtgttggacgagctgactgcacaggacaagtagcagatatcaatttgatgggctatggcaaatccggccagaatgcacagggcatcctcaccaggctatacagtcgtgccttcatcatggcagaacctgatgggtccaatcgaacagtgtttgtcagcatcgacataggcatggtatcacaaaggctcaggctggaggtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaagtcaaaaacatgtaaaccagcattgggctacagttttgcagctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtg

SEQ ID NO: 157404 - DNA, 1942 bp, Homo sapiens
  Payload ID: 10852
  Gene Symbol: ASAH2
  Gene Name: N-acylsphingosine amidohydrolase (non-lysosomal ceramidase) 2
  ENST ID: ENST00000443575
  CDS Start-End: 1-1869
atggactctgagaaatcttctgagtggcggagtgatgtcctgaacagactgcagagtaaatatggctccctgtacagaagagataatgtcatcctgagtggcactcacactcattcaggtcctgcaggatatttccagtataccgtgtttgtaattgccagtgaaggatttagcaatcaaacttttcagcacatggtcactggtatcttgaagagcattgacatagcacacacaaatatgaaaccaggcaaaatcttcatcaataaaggaaatgtggatggtgtgcagatcaacagaagtccgtattcttaccttcaaaatccgcagtcagagagagcaaggtattcttcaaatacagacaaggaaatgatagttttgaaaatggtagatttgaatggagatgacttgggccttatcagctggtttgccatccacccggtcagcatgaacaacagtaaccatcttgtaaacagtgacaatgtgggctatgcatcttacctgcttgagcaagagaagaacaaaggatatctacctggacaggggccatttgtagcagcctttgcttcatcaaacctaggagatgtgtcccccaacattcttggaccacgttgcatcaacacaggagagtcctgtgataacgccaatagcacttgtcccattggtgggcctagcatgtgcattgctaagggacctggacaggatatgtttgacagcacacaaattataggacgggccatgtatcagagagcaaaggaactctatgcctctgcctcccaggaggtaacaggaccactggcttcagcacaccagtgggtggatatgacagatgtgactgtctggctcaattccacacatgcatcaaaaacatgtaaaccagcattgggctacagttttgcagctggcactattgatggagttggaggcctcaattttacacaggggaaaacagaaggggatccattttgggacaccattcgggaccagatcctgggaaagccatctgaagaaattaaagaatgtcataaaccaaagcccatccttcttcacaccggagaactatcaaaacctcacccctggcatccagacattgttgatgttcagattattacccttgggtccttggccataactgccatccccggggagtttacgaccatgtctggacgaagacttcgagaggcagttcaagcagaatttgcatctcatgggatgcagaacatgactgttgttatttcaggtctatgcaacgtctatacacattacattaccacttatgaagaataccaggctcagcgatatgaggcagcatcgacaatttatggaccgcacacattatctgcttacattcagctcttcagaaaccttgctaaggctattgctacggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtg

SEQ ID NO: 157405 - DNA, 555 bp, Homo sapiens
  Payload ID: 10852
  Gene Symbol: ASAH2
  Gene Name: N-acylsphingosine amidohydrolase (non-lysosomal ceramidase) 2
  ENST ID: ENST00000474434
  CDS Start-End: 1-156
gctcagcgatatgaggcagcatcgacaatttatggaccgcacacattatctgcttacattcagctcttcagaaaccttgctaaggctattgctacggaacttcacttgtggaaatcttccctttggatgcagttgtttatgaagctgcaactgtgatgtcagaaggacacggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataaga

SEQ ID NO: 157406 - DNA, 539 bp, Homo sapiens
  Payload ID: 10852
  Gene Symbol: ASAH2
  Gene Name: N-acylsphingosine amidohydrolase (non-lysosomal ceramidase) 2
  ENST ID: ENST00000489640
  CDS Start-End: 1-435
gctcagcgatatgaggcagcatcgacaatttatggaccgcacacattatctgcttacattcagctcttcagaaaccttgctaaggctattgctacgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataa

SEQ ID NO: 157407 - DNA, 632 bp, Homo sapiens
  Payload ID: 10853
  Gene Symbol: ASAH2B
  Gene Name: N-acylsphingosine amidohydrolase (non-lysosomal ceramidase) 2B
  Uniprot ID: P0C7U1
  ENST ID: ENST00000374006
  CDS Start-End: 66-563
gtggaagcggacctgaggagtcgcaattgtgaacaggttcggtgctgcggctggggctcagcgatatgaggcagcatcgacaatttatggaccgcacgcattatctgcttacattcagctcttcagaaaccttgctaaggctattgctacgtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaa

SEQ ID NO: 157408 - DNA, 3715 bp, Homo sapiens
  Payload ID: 10853
  Gene Symbol: ASAH2B
  Gene Name: N-acylsphingosine amidohydrolase (non-lysosomal ceramidase) 2B
  Uniprot ID: P0C7U1
  ENST ID: ENST00000374007
  CDS Start-End: 785-1267
taattttcttcctttcttttttttcctgcgagacggtgggcgggggtatctccctaagttgcccaggctggtcttgaactcctgggctcaagcgatcctcccgcctcagcctcccaaagggctgggattacaggcatgagccaccgcttcctgccaaaagagggctttagggcacccccagaacctgagatctccctcatctgtcatctttaaagagaaggaagtcgactcccagtcgagccatagtccatttgtcccgggcacggtgactccggggtggccaggaccaaatgtgtctccttctggcttttgcaccgcaccaactaatccgcggcaggccgcacagctgccctggccttcgcggaggactaaggcgagggcggtgtacgctgctccggagtcccaccgcgggagttgaggcagcggattccgagggcagggtggggcggaatcgggagggatgcggacccggtggaacgcactgcgcagacggcgccggcgcccgcacacagctgttgactagtcttccagctctcccctggaagtcgtccaggcgccggtctcttttttctgcctttttgtttccctccccgcgagtcggcgcgacggtgaatttccgtttccggcggtgtggaagcggacctgaggagtcgcaattgtgaacaggttcggtgctgcggctggggctcagcgatatgaggcagcatcgacaatttatggaccgcacgcattatctgcttacattcagctcttcagaaaccttgctaaggctattgctacggacatggtagccaacctgagcagaggtccagaacctccctttttcaaacaattaatagttccattaattcctagtattgtggatagagcaccaaaaggcagaactttcggggatgtcctgcagccagcaaaacctgaatacagagtgggggaagttgctgaagttatatttgtaggtgctaacccgaagaattcagtacaaaaccagacccatcagaccttcctcactgtggagaaatatgaggctacttcaacatcgtggcagatagtgtgtaatgatgcctcctgggagactcgtttttattggcacaagggactcctgggtctgagtaatgcaacagtggaatggcatattccagacactgcccagcctggaatctacagaataagatattttggacacaatcggaagcaggacattctgaagcctgctgtcatactttcatttgaaggcacttccccggcttttgaagttgtaactatttagtgaaaagttgatagatcatttaaagaacagctttactctctacacattatataagtgatttcaaatgaatgtgaactagtgaactaccatgttgacttctataatcgtccctgtttggggacagatagtttactgctaatggggtggaggggtgtgtgtgtgtgtgtgtgtgtgtgtgtgtgtgtgtgtgtgtgtgtatgtgagagagagagagagagagagaggtttgtcccatatatcttgttccagcagccatatatcttgtggtctacagcctaaagcatgatttcccttgaagtcttggggttgtttaaaggagagtcccttcaatataaaacctctgaaatattagtgagaatggctcactaatgtgaacaatgtttaaattatttatttatatatagaattactgaatattagtactgggaaaatttatagaaatcatctagtcttacccttcatcttacatataagaaaaatggtcttttcttctaatcacatttacaaaatatgatataaaccttgaccatgaatgtatgagcctaattagagaaacagaaaatcagcatgtcagttttccttcattcaaaataacatagtctttctaagcagtcattctggagttaacatgcctagttcagagccgctgtggatgctcaaatcatttctggaattgccttcaggacacaattatgagaaagtcagacttccaatattttgatcatgccttgtgtcttcctaagtgtccttatcccactggattgtgtctcttactcccaagacttattccaaatgattttttgactcttttcattaatcaaattcaccccaaaccagaaagttttgccattagcgtagatattaaaaatattactggctgggaaagcactcctcaaagcagaggttctaaattaatttatctgttcttttaccatttgctcactcactcactcatggacccattcaatcatagaatatttaagatttatatgcccagaattataatagtgcctaggccttgataattagtgaatttgtacttggggtgaatgtgtaagtgtcaaaaggtaactattatgaaggagaaaataatcgatttaatatgtaaattctggggaggcatttaaaaaatcagtaatcttcaagttatatcttgtgtatcatctgtgttggatactctaatttggggggaaagaggctccagacagtttgctaaatactattttgaaagttatttttgggcattgtaaaataccttgcttcataccccaaagaataagatatgacaatctgacatcgattgtctgaaagtactaattgcatttaaaattctttaagttaactacaacctcccagactgcaaagcaaatttccaaaccccaggtcatacttttgtatgtatgtaaaagctttagcattttagggaaaaaaatcaatctgtatttcaaaaataaactttgaggtttgaaaataataacaatattcataatggtagtattaacatctattatgtataacttaatctcaacataatttattgaattagaatgaacctggaacactttttgatgaattggtatcctagaggctgtttccttgggccttaactgctggaggattaggtaatcagggattccaagtgttgtgatcttttttctgatgacgccacagtcttcagtgtaaaagttcagaagcctaaaagaacaagtgatcctgaaagtagctgattccagacaagaaaattatattagaactcatgatatggttttttaaagtatttgttattactcagaagggttcatgaatcagtttccactacctctattccttctattgaagctttcctcaaatctacttgtgattcctgatagctcactggcaactgtaccaaggtggccactgtatcatctactgatccttctgcacctagcactcttggctccagataacgcacagaaacctattttctcaccagctgtcatttcttctagggcatgcagttctatgttcacagttcatgtgtaaaaataaaaccaaattcctggattatcaatatcagttctttacctgtgcataaaagaatatcatgaagtaattgaacttatctgttgatataaaaacacagatccaattcgtgtctgtggatgctgcaaggactggctcactggagccaaaccatgtggcggaaactcctgaaattggtggaaaaagtggaatatggcagattgggtaggtaggagaacaattttggagattttgtttctcatgttaaagtgtctgcattttatttgctgtaccctgcctactctggttttaaggattttttgacttcttcgaaaagcactgaataatctctttgccgggtctagattttttgatgagtactgtgtaaaattgtcaatattcaatggattatttaataataaattaagaattacactcataaaa

SEQ ID NO: 157409 - DNA, 1722 bp, Homo sapiens
  Payload ID: 10854
  Gene Symbol: NADK
  Gene Name: NAD kinase
  ENST ID: ENST00000342348
  CDS Start-End: 45-1289
agagcttaggcttctagtgtgggcgcacagtcaggaccataccgatggggcggccgcgtgttcgccaagcgtggcctggatgctgtggacacactggccggctcccagcaggcaggggctacctcgcgagccacatgtgtgacccggcaggtgctgagctcataggggatggcatgagtgaccccacgcctcccagtaatgcctgcacagggcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctctt

SEQ ID NO: 157410 - DNA, 3235 bp, Homo sapiens
  Payload ID: 10854
  Gene Symbol: NADK
  Gene Name: NAD kinase
  Uniprot ID: O95544
  ENST ID: ENST00000341426
  CDS Start-End: 223-1563
agtgggcgggcgcggcgcattgctgctcggcggcgccggcgccggggtccgggcggccatggggcaacaggcggccagggcgccaagggccaggtagcgacggctggcggcggcgcggcggcggggcctgcgggctcggtccggcatgtagacgcccccgcaggcgcccgcggcagcgaacggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccggcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 157411 - DNA, 3098 bp, Homo sapiens
  Payload ID: 10854
  Gene Symbol: NADK
  Gene Name: NAD kinase
  Uniprot ID: O95544
  ENST ID: ENST00000341991
  CDS Start-End: 86-1426
gtagacgtggcgggcggacccgggggcgccctccggacgcggcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatgcacattcaggaccccgcgagccagcggctgacgtggaacaagtccccaaagagcgtccttgtcatcaagaagatgagagatgccagcctactgcagccgttcaaggagctctgcacgcacctcatggaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccggcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 157412 - DNA, 3653 bp, Homo sapiens
  Payload ID: 10854
  Gene Symbol: NADK
  Gene Name: NAD kinase
  Uniprot ID: O95544
  ENST ID: ENST00000378625
  CDS Start-End: 206-1981
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccagacgcggctgcttactgctgctcggcctgccacggcgatgagacctggagttacaaccaccccatccggggccgggccaagtctcgcagcctgtctgcctcgcccgccctggggagcaccaaggagttcaggaggacacgctctcttcatgggccatgcccggtgaccacttttggaccaaaggcctgtgtgctgcagaacccccagaccatcatagccactcctttgtcactcgcatctcagctgctgccttcaccagccgtcagtcactcgggccagggcggggtcaccggacaggtgcatgttctgcctcagccctcagaccagggcgtactcagtggtccccgagctgcccgaggccagacagccccgcaggaggaagcggtgacccaggaagaggtcgaggcgctggtttgtggtcacacacagcggtgggtgcctgggccggtgtacgacgccgctgctggtggctctggctgggctcagctgagcctcagggctggaatgggtgtaggccaggccactgggcacattcaggaccccgcgagccagcggctgacgtggaacaagtccccaaagagcgtccttgtcatcaagaagatgagagatgccagcctactgcagccgttcaaggagctctgcacgcacctcatggaggcacgcggggcaggggggaagggggcctggggtgcacatggagttgggggggcctccatccacatcaccgccccgagggtggggtctgcaggtggaatgagcaggttggcactttgcttccaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggtcgagctgaagatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagtgcctgcattggaacgtccggaagaagcaagcccacttcgaggaggaggaggaggaggaggaggagggctaggtcaagcccctatccaggcccgaatccttccgctgccctccaagcgccctctggggacagaccaatctgcgtgtgtctgtgaccgcctgtctcagtggcacggccacttcctttctgtagctgggttagagcctgggtctgccttttgtccagatcagctgtttttttaaaatgtctgactttttttgcatttctaaagaagcgtgagaaatgggctgggagtgcttctgtcctgctgacaccccgcggtgggtccctggagcgcggcctccagctgccgcaatttccatgccaggatatttttccgcaaatcagtcggttgaaattcagaggagtcagaatgactcgacctgtccttcaatgttgataataaatgtctcagccaaaaaccttccttgagctgccatgcttttccccttgacctgcacctcttcccctaaaacttctgcagggaagcccctggcggaggcgccattgaaagcatggtcttgccagtggctggcaaggcggttttgttctgctcagtttctggagagggttggatgcgtcccctgccatccagccctccccgcttgaggccagcactgagtctgggacactcagcgggaagggggctggcatcgccagcgacccacacattcctcacgtagcttctgctcccaggaaggtagtttaaatcctgtatatactttttagagactcttttaaactttctgaagtgctgatgtacatactttctcgtacacacttttgtgaagatttcaaggggaagggagtcgtctgccattcaatgtttacatttatgttctgcaagacgctgtcctcagggaccattaggggaccattctgttcagtgcgatcctgatggtccgggagatgagggtttccggggctagtgatcgtgatcccttttatttgcaactgtaatgagaatttttcacactaacacagcgagggactcaacacgctgattctcctcctgcctctcccgtgagtctccagcctgcccagcaccggcagctgtggagcacgtggatgctgcctaccccggcgcccgcgtcttccacgggcacaggtgtgtggaggccgtggtcggaccctggtgtcctggttactgctgcccgggtgtcttttttttgagtaactgctctctgagttttgcacacgaagttgccctcatctgctggagatcgataaggaaggcacaagacgttctcctctgcccgtgaggagcttcccgcagccgcctggcccagcctgggcacgttctccgaggcatgtgtctccctgctcaccctcgtctgggcacctcagcatctgtggacttgagcgtccaaaaaccctgagtgtgattctgggcagccggcctggcttgaagtccgccatgaccctgggcacaggggaagcccagccgtgggcttaggagagagggaccagcgcccagcgttagggctggaagacggcagtgttcagaattccagccgctcatctgaacacagaaggtgtgaactgacctctaaagcagcgtgagatgggaatgatctagaaaactttggatttttgaagtaaattttaatgtttcatattaatttcttgaaaatgtattaaatgtcattgaaagccttattacgcttttcagatcctttcaataaacaagacttgtagaaaataa

SEQ ID NO: 157413 - DNA, 890 bp, Homo sapiens
  Payload ID: 10854
  Gene Symbol: NADK
  Gene Name: NAD kinase
  ENST ID: ENST00000469045
  CDS Start-End: 1-133
gtccccaaagagcgtccttgtcatcaagaagatgagagatgccagcctactgcagccgttcaaggagctctgcacgcacctcatggagaagagcaggcgtgggggttgcggcgcccaggaaagccactcctgaaataacagccttagtcaattcctgagagggagccccctccgcccagtcatctcttaaaggagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcagcacggcgtatgcggccgcggccggggcctccatgatccaccccaacgtgccggccatcatgatcacgcccatctgcccccactcgctgtccttccggcccatcgtggtccccgcaggggt

SEQ ID NO: 157414 - DNA, 475 bp, Homo sapiens
  Payload ID: 10854
  Gene Symbol: NADK
  Gene Name: NAD kinase
  ENST ID: ENST00000489538
  CDS Start-End: 1-225
gagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctcctacctgtccaatgtggatgtctacctggacggacacctcatcaccacggtgcagggcgacggagtgatcgtgtccaccccgacgggcag

SEQ ID NO: 157415 - DNA, 683 bp, Homo sapiens
  Payload ID: 10854
  Gene Symbol: NADK
  Gene Name: NAD kinase
  ENST ID: ENST00000497186
  CDS Start-End: 1-93
gccagcctactgcagccgttcaaggagctctgcacgcacctcatggagaagagcaggcgtgggggttgcggcgcccaggaaagccactcctgaaataacagccttagtcaattcctgagagggagccccctccgcccagtcatctcttaaaggtcctgcttcctcctggcgcgttggtgatgaagtttcagcgagaacatgatcgtgtatgtggaaaagaaagtgctagaagaccctgccatcgccagcgatgaaagctttggggcagtgaagaagaaattctgtacctttcgagaagattatgatgacatttccaatcagatagacttcatcatctgcctggggggagacgggacgctgctgtacgcttcctcgcttttccagggcagcgtccctccggtcatggccttccacctgggctccctgggcttcctgaccccattcagctttgagaactttcagtcccaagttactcaggtgatagaggggaacgcagctgttgttctccggagtcggctgaaggtcagggtggtgaaggagctccgggggaagaagacggccgtgcacaatgggctgggtgagaacggctcgcaggctgcaggcctggacatggatgtcgggaagcaggccatgcagtaccaggtcctgaatgaggtggtgattgacagaggcccctcctccta

SEQ ID NO: 157416 - DNA, 269 bp, Homo sapiens
  Payload ID: 10854
  Gene Symbol: NADK
  Gene Name: NAD kinase
  ENST ID: ENST00000498806
  CDS Start-End: 1-117
gtcctgaatgaggtggtgattgacagaggcccctcctcctacctgtccaatgtggatgtctacctggacggacacctcatcaccacggtgcagggcgacgatcatgctgtcacctgaagcaaggaacacagcatgggtgtcctttgatggacggaagagacaagagatccgccatggagacagcatcagcatcactacctcatgctacccgctcccctccatctgtgtgcgggaccccgtgagcgactggtttgagagcctcgcccagt

SEQ ID NO: 157417 - DNA, 2507 bp, Homo sapiens
  Payload ID: 10855
  Gene Symbol: NADK2
  Gene Name: NAD kinase 2, mitochondrial
  Uniprot ID: Q4G0N4
  ENST ID: ENST00000282512
  CDS Start-End: 237-1076
ggtgcggggaggtcgcccccgggcggcgaagcagccattatgcaggccttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaa

SEQ ID NO: 157418 - DNA, 2243 bp, Homo sapiens
  Payload ID: 10855
  Gene Symbol: NADK2
  Gene Name: NAD kinase 2, mitochondrial
  Uniprot ID: Q4G0N4
  ENST ID: ENST00000381937
  CDS Start-End: 1-1329
atgacttgctaccgaggcttcttgctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacaca

SEQ ID NO: 157419 - DNA, 3614 bp, Homo sapiens
  Payload ID: 10855
  Gene Symbol: NADK2
  Gene Name: NAD kinase 2, mitochondrial
  Uniprot ID: Q4G0N4
  ENST ID: ENST00000397338
  CDS Start-End: 223-1062
agatgccggtcctgcctctctcgcggcccccagcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatagaaaaaaagacattcactgtataagaaaatggatggactgaaccaattagaattgataccagtgaaatttttatattgcttacaattggtaaccaagagtgctgatacctttttaaatttagaggggcaggcttaaataaaggactaaatatttaggatttgaaacttaactgtataagtgtgttttccttccctttcctcctaattgtgggattgtcagaactgaacacatatcatttgattagtgcatattttttatagtacctgaaaaccaagattttgaaaaaattttcaagacagagaattttgataaatcctgacattgacctaattgacataggtaaatatgtttgtatatgtgctaataattttctaatttcggaacacgatgatgttatgactattgatttaaaaatttcaaataataatttttgaaattatagatgaatgctttcatttgagtttcattctgtaattcagcagttctgggtgaaatacagatagcaaaacaaatcatgatgctgttacaaatgtattagttatccaataagtgttttaagtcaatttttttaaaatgatatgagtcttacaggtttcttccatctttaaaatgctcaaacatggattcagggactaaaaggatgaactgattagacattttctattaggagtttggtaaaatattgtaaaaatatcttcacctgtgttaggagtattatcagaaagaatggattctttaataaatatgtaaaacacagtagttttggaattgccttccttagtattgtggttttcacctagcttatattccaagatttacagaatagcttttaggataagatgttaggactttttttttttccccatgagaattcctttatttttggaggaaattattatctaattattgatctacttataagtaatcctagaatttttgccaaaagatcctgtcgttgcataatcaaacagttggtattctcgtgccgttgttcaaagtcatgtgtttctttcatttggtgctgaaaatttctgttcaatcattgacaaatatttattgaacacccactctgtgccatgtaaaactatgtcaggtgctggatatgttgatgaatgaaacagactctatccttatacaatttgagtcttgtgggctcagaagtaaattctgtgaaagctggacggatagtcgaattgagtgctcttagttttgccaatatttaacatgttgttcttatcaattttttaaaataaatgttaatgtacaaagttaatctaggttttgatgtatatccagagaatcaatttttcttaaagtatctgcgtagacattcatagcaaagaatttatgacatatcagatagaaatacattaaaatgtagtgttttcccagagattgatctggctttttttttttgatatacataagataccactttataaagaagctccatactatagaacctcccctaacaggcttaaaataccttctttttttttttttttttttttgagaacggagtcttgctttgtcacccaggctggactgcagtggcatgatctcggctctgcaacctccatctcccaggttcaagcgattctcctgcctcagcctcccaagtagctgggattacaggcaggcaccactatgcctggctaattttttgtatttttagtagatatggggattcaccatgttggtcaggctggtctcgaactcctgaccttgtgatctgcctgcctcggcctcccagtattgggattacaggcatgagccaccatgcccggccttaaaatgccttcttaaaggaaaaatgccaactccatccttaatctcaaggaaatctgattgtccaaatagatctgttaatatgtaacatattaataggtaacttgctgtgtaaaattataagccatattttaaaaggttttaaaaatacttattgtgctccatttgtgatataatttctaacatttctgctctgtgatgggggtttatttgtaagaataagaggcaaaggaatgttagcatagcaaaaatgtgtttgaatgagttaaccttttaatcgcaaccctatgtgaataaaattactccactgttacctcttctttttaacatttcttatttccctctcaaggggtcattatttgaaaactagttttcacaaaatgttatgtttcagaagtgtttccccactgctgtgtattattattctgtgccctgttgacttcattcactgttaacatttgacatagaatgattagttattaaatcagggtgaagtgcttacctggtcagtgtaggctcttcagataattttgacttaatatttttgatactccttgtgcatttacattcatggcccctgtacattaaatcatattacatgtttta

SEQ ID NO: 157420 - DNA, 1233 bp, Homo sapiens
  Payload ID: 10855
  Gene Symbol: NADK2
  Gene Name: NAD kinase 2, mitochondrial
  Uniprot ID: Q4G0N4
  ENST ID: ENST00000514504
  CDS Start-End: 1-1233
atgacttgctaccgaggcttcttgctgggcagctgttgtcgcgtggcgggcggccgggcggcggcgctgcggggaccgggtgcgggaggccccgccgcgcggccccggctgggcggtgacggtggcggccggcggcacctggggcaggggcagccgcgcgagctggcgggctgtggcagccgcgcggacggcggcttccgcccctcccgggtggtggtggtggccaaaaccacccggtacgagttcgagcagcagcggtaccgttacgcggagctctcggaggaggacctgaagcagctgcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccaggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtga

SEQ ID NO: 157421 - DNA, 1437 bp, Homo sapiens
  Payload ID: 10855
  Gene Symbol: NADK2
  Gene Name: NAD kinase 2, mitochondrial
  ENST ID: ENST00000506945
  CDS Start-End: 374-1279
atcgcctaacagaattctacctctttctcaggccgcagccaatggcgcggcccctcggatccggagccgccgcgggctctgattggccgatagagttagcctgggggcgggagaagagcgacctcggggaagcgtgtggtgcggggaggtcgcccccgggcggcgaagcagccattatgcaggccttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccagaatgtcttattcttgggctgtagcagtggacaatttaagaagaagtatacccactctaaagggactggcttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgatag

SEQ ID NO: 157422 - DNA, 569 bp, Homo sapiens
  Payload ID: 10855
  Gene Symbol: NADK2
  Gene Name: NAD kinase 2, mitochondrial
  ENST ID: ENST00000502355
  CDS Start-End: 1-413
cttcctactatgagatttcagttgatgatggtccatgggaaaaacagaagagttcagggctcaatttgtgtactggaacaggatcaaaggcctggtcattcaatattaacagggttgcaactcaggctgtagaagatgttttaaatattgtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtgaaggatttcctcatgacaaattttgattactggcgagaatatttttacttcagaaacagactaccagtcgtaaagtgacattttttggttattgttgagactgcttgcccgtgggctcagaagtgagatttgcattattcttctgttggattctgat

SEQ ID NO: 157423 - DNA, 579 bp, Homo sapiens
  Payload ID: 10855
  Gene Symbol: NADK2
  Gene Name: NAD kinase 2, mitochondrial
  ENST ID: ENST00000511088
  CDS Start-End: 334-579
attatgcaggcgtgagtgaaacgaataaacaaacaaacaaaacccactagctggggcctccatttcttccccgcccacctttctcccgcgtggggtctcccgtttcccaatcgccacgctttccccgccttcgtcaacgcctggcttgcattgaaaggctctagttacagtggacttcttgaacgacatcatattcacaccaaaaatgtagaacatattatagatagtttacggaatgagggaattgaggttcgtctagtaaagaggagagaatatgatgaagagactgttcgatgggcagatgctgtcatagctgcaggaggtgatggcacaatgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttg

SEQ ID NO: 157424 - DNA, 744 bp, Homo sapiens
  Payload ID: 10855
  Gene Symbol: NADK2
  Gene Name: NAD kinase 2, mitochondrial
  ENST ID: ENST00000617628
  CDS Start-End: 1-744
atgctgctggcagcgagtaaagtcttggacagacttaaaccagttataggggtaaacactgatccagaacggtctgagggtcatttatgcctgcccgttcgatatacacattcctttccagaagccttacagaagttctatcgtggtgagttcaggtggttgtggaggcagagaatcaggttataccttgaagggactggcataaaccctgtacctgtggaccttcacgagcagcagctaagcttgaatcagcacaatagagcccttaacattgaaagagctcatgatgaaaggtctgaggcttcaggaccccaacttctgccagtgagagcactaaatgaagtcttcattggggagagtctgtcatccaggtcattcaatattaacagggttgcaactcaggctgtagaagatgttttaaatattgcaaaacgacaaggaaatttgagtcttccattgaacagagaattggtagagaaagtaacaaatgaatataatgaatcactgctctacagtccggaagaaccaaaaatacttttcagtattcgagaaccaatagcaaatagagttttctcaagcagtcgtcagcgttgtttctcctcaaaggtttgtgttcgttctcgttgttgggatgcctgtatggttgtggatggaggaacttcttttgagtttaatgatggtgcaattgcttcgatgatgatcaataaagaagatgagcttcgaactgtgcttcttgaacagtga

SEQ ID NO: 157425 - DNA, 2773 bp, Homo sapiens
  Payload ID: 10856
  Gene Symbol: NADSYN1
  Gene Name: NAD synthetase 1
  Uniprot ID: Q6IA69
  ENST ID: ENST00000319023
  CDS Start-End: 189-2309
agacggggcggggcgatccgtaggcagggcctgacgccgcagtcctccttggccggagcctcaacggatgggcggggagggggcggggccgggcaacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttgtggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccaagtgctgcgcaaagccaacaccagggtggatctcgtgactatggtcaccagcaagaacggtgggatttacttgctggccaaccagaagggttgtgacggggaccgcctgtactacgacggctgtgccatgattgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaagaggctggaatccaatgcacatgattttgacctcccgccagcgtgcgcttccccgcgaagtctggcattctccgaaggaagccgcctgggtaggagggttccaaccgccgccccgtgtggcatctttgctgcaggaacaagaacagtagctcccgggaagggaggggtgtcatgagcagaaaatgaaggagagaagaccttctctcccacccacacacaccttcctgtcctgggttccagaaggttctggggagatggtccctgcagagctttcttcc

SEQ ID NO: 157426 - DNA, 582 bp, Homo sapiens
  Payload ID: 10856
  Gene Symbol: NADSYN1
  Gene Name: NAD synthetase 1
  ENST ID: ENST00000527852
  CDS Start-End: 1-250
tggtggccagggtgctgtcactttgggaagcagccagagaaccacaggatgcgtgaatcggtctccttgtcttcatgggcatctccggccaggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcaccc

SEQ ID NO: 157427 - DNA, 2416 bp, Homo sapiens
  Payload ID: 10856
  Gene Symbol: NADSYN1
  Gene Name: NAD synthetase 1
  ENST ID: ENST00000530055
  CDS Start-End: 1222-2229
ctatgttgcctaggatggtcttgaactcctgggctaaagcaatcctcttgcctcggcctcccaaagtgttggaattacaggcgtgaactaccgtgcccagcctttttttcatagcagttttattaagttgtatttgccataccacccaatgtatccatttaagcacctgattcagtggtttttcatgtactcatggagttatgcagccacaatcttagcgcattttcattaccccaaaaagaaactgtacccattatgcaccccgttcccctcctccggtcctggcaaccacaagtctactgtctgtcttcatggatttgcctattctcgacgtttcattgggatgaaatcacacagtgtatggcttccacactttactgtgctgttgtcaaggtttatctatgtgttgggtgcagccaccccttggtatccacagggattggacccaggagcctgcaccgatcccctgcagggatgcctgtgtcccacagtgccccctgcaaaactcactgatatgaagagtcggccctctgtatccatgggcttcagatcctgtgattactgtatcttctgtctgtgtgcagttgaatctgcgggtgtagaacccacagacacagggagtggctgtagcttatccctttgtatggtcagagagtgttccgtagcggggatggacacgtgttcattcactcttccactgatgggcatcgggaatgtttccactttctgtctatcattaacaattctgctacaaacatacatgtacttctgttggaggggacacatgttttcatttctcttgggtgtgtctatccaggagtggaattggctgggtcttatggtaactctgttaactgttttttgctttttggttttttgtttgttttttgagacggagtttcacccttgctgtgaactaccataggctggagtacaatggcgcaatcccagctcagcacaacctctgcctcgtagattcaagccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaag

SEQ ID NO: 157428 - DNA, 3616 bp, Homo sapiens
  Payload ID: 10856
  Gene Symbol: NADSYN1
  Gene Name: NAD synthetase 1
  ENST ID: ENST00000525200
  CDS Start-End: 1-779
aaaacagaggagcaagatacaggcttggaccagagctggaaatatgcggctacggatgttgggatcattattacgagtcggacaccctcttgcactcgtttcaagtcctagcggcccttgtggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccaagtgctgcgcaaagccaacaccagggtggatctcgtgactatggtcaccagcaagaacggtgggatttacttgctggccaaccagaagggttgtgacggggaccgcctgtactacgacggctgtgccatgattgccatgaacggaagcgtctttgctcaaggatcccagttttctctggatgacgtgcaaacaagaaaaaatgggctattattgccacaaatggaaacaaatcccaagtgcacaaatacaacaaaaagtaacttttagttctgccccaagccggcgtgggtgggagcgtctccactctcgggctcagaccacacgcgggtccacagcactgcctcccacacacagcattgcctgactcgtctttggacccgacggccttccactctgctcttgttgggaatgggcattaaagcagcggattcaccgaggcaggcggtagcaccggaggcgagttctgcagctggctttgcaggagcagggcgagcttgtgtcctggcgtcgccgactctgcgaggctgtctgagcagttcattgctttgctcccgctgcgttcccatcctcatgattctgtctggtgctttctgcacagcataggtgtggtcagcacggaggcggttacaaaaccaaaccagtttcatagtggaccaagtgaacttcaccctgaacaagaattccacggtcttttcaggggtttcttgcacgggggcaggcaagggtgtggccgtctcgactccaggccctgctttccacatgacagtgtccccagaggcctccttgcgcttcatcattaaccgcgacagagctggaagggctttgaagagaaggattaagttcctgctgatgggaagtgtggtcctctccccgttcacgtcagagccacaggcacattggtggtcgtgttgattggcaggtgtgttggcaatcaatcacctgccccaggacccccgcaggttcccggccccacatcaagccaccaaatcggagtcctcgggggtctgtatatttagtgagcaccaggcagttgtttcgtgcattagaatccgggagccgttgccttacacgtctctagagttcctgatgttgcctgagagctccgtcgtaggctgtggccacaggcctgctgtattcagagtggccgcgctgtcctcaggctcgggccactgccctccaccaggtcctccgtggtgcacctgaaatggtcaacagaagtcttgtgacacgtggaatcatttcagagtcaccccttctgcctcctgctcaagcaacagacctgccgatcacccccgtcgggcccgcgtttctcagggtcttcctaatcccctgggctttccggcttgtcgtgtgcctggagtcaggccgccgtgcggcaggctgttaacctagcctcggggagagtgggatggagccaccttctcatggaacgatcctcgccttccctcatctccattgttttatggcttcacacggaccgtggctttctgcatggaagcttggtggccagggtgctgtcactttgggaagcagccagagaaccacaggatgcgtgaatcggtctccttgtcttcatgggcatctccggccaggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaagag

SEQ ID NO: 157429 - DNA, 2999 bp, Homo sapiens
  Payload ID: 10856
  Gene Symbol: NADSYN1
  Gene Name: NAD synthetase 1
  ENST ID: ENST00000528509
  CDS Start-End: 81-965
ggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttgtggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccaagtgctgcgcaaagccaacaccagggtggatctcgtgactatggtcaccagcaagaacggtgggatttacttgctggccaaccagaagggttgtgacggggaccgcctgtactacgacggctgtgccatgattgccatgaacggaagcgtctttgctcaaggatcccagttttctctggatgacgtggtaatgagcgggcctggacatgcctgggggagggttctctgtgcagagaccgagctcctggctctcccctgtaagccgggtgcttagtgagggcccctgtggagaagcccccgggggtcccgcctgctcctggctctcccctgtaagccgggcgcttagtgagggcccctgtggagaagcccccgggggtcccgcctgctcctggctctcccctgtaagccgggtgcttagtgagggcccctgtggagaagcccccaggggtcccgcctgctctgatggcctcaaatttacctggttggtgaggggggacctcccgccctcgggtctggagacagctgaaccccgacacacagcacatagtagtggacggatgaggttgagggcagcttacgagtcctgcgttcccacagtgcgggaggagggctccgtgccacgcagggccaggtgggagtgtgctcaggaacagaggggacggcccccgctgtgggaggcgggctctgtggtgatgagaggatgggtgccgcctggcccctgcgggtgggtgtcgttggtttgtttgaattccgagggctggcagggaaccaaagccactcctttgaaattagcaggctccatggcccctgagacaggtccagggatcccatgtatggtgaggccgttcaaggccctgtctgtcttccttgggtgttgaggccacatatactcatctgaggccttatgccacgctgcccctgagtcctgggaagcagaagtggagaccccaggacactctggtcagggaggctttgttctgtggggatctctgagcacacagcggccagctgcgtgagggagggccctgggggagctgtgagttacaggtcggaagcgccattgctatcccgaagcgacacagatatgtgggtgctccgaggaaggagatgacagagaacaaagctaagaaccctgcttggcacattcctcaccagcaactgagctgccgcttggaatggggttcaggaccttgttggggccccagattcctttgggaagctgatgaaagctctgcacattctgcggctaaagatgcgcattagcacagggcaaggcttcccagcattgcctgactcgtctttggacccgacggccttccactctgctcttgttgggaatgggcattaaagcagcggattcaccgaggcaggcggtagcaccggaggcgagttctgcagctggctttgcaggagcagggcgagcttgtgtcctggcgtcgccgactctgcgaggctgtctgagcagttcattgctttgctcccgctgcgttcccatcctcatgattctgtctggtgctttctgcacagcataggtgtggtcagcacggaggcggttacaaaaccaaaccagtttcatagtggaccaagtgaacttcaccctgaacaagaattccacggtcttttcaggggtttcttgcacgggggcaggcaagggtgtggccgtctcgactccaggccctgctttccacatgacagtgtccccagaggcctccttgcgcttcatcattaaccgcgacagagctggaagggctttgaagagaaggattaagttcctgctgatgggaagtgtggtcctctccccgttcacgtcagagccacaggcacattggtggtcgtgttgattggcaggtgtgttggcaatcaatcacctgccccaggacccccgcaggttcccggccccacatcaagccaccaaatcggagtcctcgggggtctgtatatttagtgagcaccaggcagttgtttcgtgcattagaatccgggagccgttgccttacacgtctctagagttcctgatgttgcctgagagctccgtcgtaggctgtggccacaggcctgctgtattcagagtggccgcgctgtcctcaggctcgggccactgccctccaccaggtcctccgtggtgcacctgaaatggtcaacagaagtcttgtgacacgtggaatcatttcagagtcaccccttctgcctcctgctcaagcaacagacctgccgatcacccccgtcgggcccgcgtttctcagggtcttcctaatcccctgggctttccggcttgtcgtgtgcctggagtcaggccgccgtgcggcag

SEQ ID NO: 157430 - DNA, 928 bp, Homo sapiens
  Payload ID: 10856
  Gene Symbol: NADSYN1
  Gene Name: NAD synthetase 1
  ENST ID: ENST00000525593
  CDS Start-End: 1-335
cggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaaggagtctgttacccacgtcacatcgtggatgccccctgcccggataggtctgagtgcactggggtggccggcaccccacaccttctcagggagcacccagcaggatacctgagattctccttaggccttggatgggagctggaggcttctggctgcctcctgcaccccagatgtgtggcaacggggtggggagtgtgtcacccgaaagatgatcagatggccggttcctgccttaactgatgacattccaccacaaaagaagtgaaaatggcctgttcctgccttaactgatgacactatcttgtgaaattccttctcctggctcatcctggctcaaaagctcccctactgagcaccttgtgacctccactcctgtctgccagagaacaacccccctttgactgtaattttcctttacctacccaaatcttataaaacggccccacccctatctcctttcgctgactcttttcagactcagcccgcctgcacccaggtgaaataaacagccttgttgctca

SEQ ID NO: 157431 - DNA, 479 bp, Homo sapiens
  Payload ID: 10856
  Gene Symbol: NADSYN1
  Gene Name: NAD synthetase 1
  ENST ID: ENST00000527963
  CDS Start-End: 1-178
caagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtgaattacttggaaactgcacaacacacccgctgttttcaacagagttcagtcacctcttgagggctcttctgattcttatcttggtagagcatctcctcaaggatttctgcagctacctaggaggccaaggcgggaagattccttaagcccagaagtttgaaggtgcagtaagctgtggtcacgtcactgcaatccagcccaggtgacagaggaagacttcatct

SEQ ID NO: 157432 - DNA, 820 bp, Homo sapiens
  Payload ID: 10856
  Gene Symbol: NADSYN1
  Gene Name: NAD synthetase 1
  ENST ID: ENST00000529840
  CDS Start-End: 372-820
gaagtcctgacggccacgctggatctggaggacgtccggagctacagggcggagatttcatctcgaaacctggcggctggagtacaatggcgcaatcccagctcagcacaacctctgcctcgtagattcaagccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagag

SEQ ID NO: 157433 - DNA, 574 bp, Homo sapiens
  Payload ID: 10856
  Gene Symbol: NADSYN1
  Gene Name: NAD synthetase 1
  ENST ID: ENST00000529120
  CDS Start-End: 87-353
aggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttgtggagtctcccgtcactcaggacatcatctgcgacgtggggatgtaagtgccagtgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcgg

SEQ ID NO: 157434 - DNA, 1929 bp, Homo sapiens
  Payload ID: 10857
  Gene Symbol: NSDHL
  Gene Name: NAD(P) dependent steroid dehydrogenase-like
  Uniprot ID: Q15738
  ENST ID: ENST00000370274
  CDS Start-End: 195-1316
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtctttttgtgtctctctgtttaccccctcccttgccccctcttctggtttatacatttcattccagtgtccttgtacataatcaaggaagctgtaggaagctacaacccatttgttagttctgatggagaaccatttccatgcagaccaatactagagtgaagcctctagactttgttcaagatactctatcttcaaaatatcccagaagaaaaacagaagctgttaacacacaggtgagactttacatatacatttcatactgacagtgagcttagagcaaaagctgaaagctgaaatgactgtaattcctccccagtctctgttgcttgttcaactccttacatgttccacattctctttcaggta

SEQ ID NO: 157435 - DNA, 1630 bp, Homo sapiens
  Payload ID: 10857
  Gene Symbol: NSDHL
  Gene Name: NAD(P) dependent steroid dehydrogenase-like
  Uniprot ID: Q15738
  ENST ID: ENST00000440023
  CDS Start-End: 262-1383
cgccgagctgggccaatcctcttggtggaggaagctcggctgattctcggctcacgcgggaggggagtaaagggtggcggtccgggcctggagttcagtgggtgcagcctgcttgcgagctgaggccagacaggggggcgcctacggacggataaggaggagcattccaggccgagacgccctcatcagcagagtcacaggagttttggaagtgagagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctctcccgagactcgacactgggtgggaaggcatttcacatcaccaatgatgagcccatccctttctggacattcctgtctcgcatcctgacaggcctcaattatgaggcccccaagtaccacatcccctactgggtggcctactacctggccctcctgctatccctgctggtgatggtgatcagtcctgtcatccagctgcagcccaccttcacacccatgcgggtcgcactggctggcacattccactactacagctgcgagagagccaaaaaggccatgggctaccagccactagtgaccatggatgatgctatggagaggaccgtgcagagctttcgccacctgcggagggtcaagtgagggacactggaggctgggctctctcgacacgttgctcagccagtcactccttcccctgtggattgatgaaataacatcctttgaatgagtttgctctgagcctgtgactccttctgctaggcagagagcgcaccctactctttccgtgacgatgagggcggcaaaaacagacatttcttccttcatggaactggatttggatttcttgaagcaggcagcttcatattataccgatttgttctctgtc

SEQ ID NO: 157436 - DNA, 994 bp, Homo sapiens
  Payload ID: 10857
  Gene Symbol: NSDHL
  Gene Name: NAD(P) dependent steroid dehydrogenase-like
  ENST ID: ENST00000432467
  CDS Start-End: 232-994
gaagctcggctgattctcggctcacgcgggaggggagtaaagggtggcggtccgggcctggagttcagtgggtgcagcctgcttgcgagctgaggccagacaggggggcgcctacggacggataaggaggagcattccaggccgagacgccctcatcagcagagtcacaggagttttggaagtgagagaaaagaaaagttgattacaaacgggaccatattttgcttcgaaatggaaccagcagttagcgagccaatgagagaccaagtcgcacggactcatttgacagaggacactcccaaagtgaatgctgacatagaaaaggttaaccagaatcaggccaagagatgcacagtgatcggtggctctggattcctggggcagcacatggtggagcagttgctggcaagaggatatgctgtcaatgtatttgatatccagcaagggtttgataatccccaggtgcggttctttctgggtgacctctgcagccgacaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcagaaactcattttaaccagcagtgccagtgtcatctttgagggcgtcgatatcaagaatggaactgaagaccttccctatgccatgaaacccattgactactacacagagactaagatcttacaggagagggcagttctgggcgccaacgatcctgagaagaatttcttaaccacagccatccgccctcatggcattttcggcccaagggacccgcagttggtacccatcctcatcgaggcagccaggaacggcaagatgaagttcgtgattggaaatgggaagaacttggtggacttcacctttgtggagaacgtggtccatggacacatcctggcggcagagcagctct

SEQ ID NO: 157437 - DNA, 2912 bp, Homo sapiens
  Payload ID: 10858
  Gene Symbol: NQO1
  Gene Name: NAD(P)H dehydrogenase, quinone 1
  Uniprot ID: P15559
  ENST ID: ENST00000320623
  CDS Start-End: 513-1337
tttcgtgccaaggctaaaagggcatgcccacttgatccctggactctcttgggacgacttccaccctgcatcctcttgcacctcagggcacagtgcgcagatgggcttgccttagcacccccagccagatttttgaggcctctgtcacacacacccctacaatcccctcccccagccccgagagacttttcttgacttccaccagttgctccggcgggtgagagtggagaggcccctccttcatcccccaggctccctcccttcctggagctgcagcctcagcatcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttactatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagacccaca

SEQ ID NO: 157438 - DNA, 1105 bp, Homo sapiens
  Payload ID: 10858
  Gene Symbol: NQO1
  Gene Name: NAD(P)H dehydrogenase, quinone 1
  Uniprot ID: P15559
  ENST ID: ENST00000379046
  CDS Start-End: 146-856
aagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctag

SEQ ID NO: 157439 - DNA, 2527 bp, Homo sapiens
  Payload ID: 10858
  Gene Symbol: NQO1
  Gene Name: NAD(P)H dehydrogenase, quinone 1
  Uniprot ID: P15559
  ENST ID: ENST00000379047
  CDS Start-End: 230-952
atcctccgcccagcaccccaggattcaggcgttgggtcccgcccttgtaggctgtccacctcaaacgggccggacaggatatataagagagaatgcaccgtgcactacacacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataaccaaaatccgactgggctcaagaggccacttagggaaagatgtagaaagatgctagaaaaatgttctttaaaggcatctacacaatttaattcctctttttagggctaaagttttagggtacagtttggctaggtatcattcaactctccaatgttctattaatcacctctctgtagtttatggcagaagggaattgctcagagaaggaaaagactgaatctacctgccctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaatttttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattcaagaaaggaaatagtaccttcaatacttaaaaatagtcttccacaaaaaatactttatttctgatctatacaaattttcagaaggttattttctttatcattgctaaactgatgacttactatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacagtatccacaatagctgacggctgggtgtttcagtttgaaaatattttgttgccttcatcttcactgcaattttgtgtaaatttctcaaagatctgaattaaataaataaaattcatttctacagacccaca

SEQ ID NO: 157440 - DNA, 924 bp, Homo sapiens
  Payload ID: 10858
  Gene Symbol: NQO1
  Gene Name: NAD(P)H dehydrogenase, quinone 1
  ENST ID: ENST00000439109
  CDS Start-End: 122-730
acacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgactgtattcgtgcatttttggatcatttttaactgattcttatgattactatcatggcatataac

SEQ ID NO: 157441 - DNA, 892 bp, Homo sapiens
  Payload ID: 10858
  Gene Symbol: NQO1
  Gene Name: NAD(P)H dehydrogenase, quinone 1
  ENST ID: ENST00000564043
  CDS Start-End: 117-878
acacgcgactcccacaaggttgcagccggagccgcccagctcaccgagagcctagttccggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctg

SEQ ID NO: 157442 - DNA, 891 bp, Homo sapiens
  Payload ID: 10858
  Gene Symbol: NQO1
  Gene Name: NAD(P)H dehydrogenase, quinone 1
  ENST ID: ENST00000561500
  CDS Start-End: 68-877
gttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagagtttcactccgtcacccaggttggagtgcatgctcagcccccttgccgtgatagcttgcaacaccttgggattcttgggagtcctcaccagcaagaaggctctcaccagacacagcccctccacctggacttctcagcctccatggctgtaagaaattctttttctttatacattgcccagcttcaggtattctgttaaaatcaagagaaaac

SEQ ID NO: 157443 - DNA, 1515 bp, Homo sapiens
  Payload ID: 10859
  Gene Symbol: NQO2
  Gene Name: NAD(P)H dehydrogenase, quinone 2
  Uniprot ID: P16083
  ENST ID: ENST00000338130
  CDS Start-End: 713-1408
agcgagtgcgcggtccagtgcggccggaacctggcgcaactcctagagcggtccttggggagacgcgggtcccagtcctgcggctcctactggggagtgcgctggtcggaagggggatggagacagaagtcacaaactcacatgccaccagccatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaagctttaggttcattcttgtaagtgttgctggtgtcagaataggaacctccctgcgctttgaagggatgaatgtgacctctcccacattctccggtgctgtgatgtaccttaaacacagcaagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctgattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggg

SEQ ID NO: 157444 - DNA, 1098 bp, Homo sapiens
  Payload ID: 10859
  Gene Symbol: NQO2
  Gene Name: NAD(P)H dehydrogenase, quinone 2
  Uniprot ID: P16083
  ENST ID: ENST00000380430
  CDS Start-End: 296-991
cagggatttcagctggccggccatatggccctgtgggtcgtcgcgcccgggccagggaccattctgtacataggatcgtgcttggctctcacggaacgcgcccacacgcagggtcccggtgtcgaatcgtctggtggaatctgccctcaaccctatggagcgggtgctggtatcatagtcatattacaagtaggaatcagcgggcccaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctgggg

SEQ ID NO: 157445 - DNA, 1021 bp, Homo sapiens
  Payload ID: 10859
  Gene Symbol: NQO2
  Gene Name: NAD(P)H dehydrogenase, quinone 2
  ENST ID: ENST00000380441
  CDS Start-End: 340-921
cagtgcggccggaacctggcgcaactcctagagcggtccttggggagacgcgggtcccagtcctgcggctcctactggggagtgcgctggtcggaagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctgattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagcta

SEQ ID NO: 157446 - DNA, 851 bp, Homo sapiens
  Payload ID: 10859
  Gene Symbol: NQO2
  Gene Name: NAD(P)H dehydrogenase, quinone 2
  ENST ID: ENST00000380454
  CDS Start-End: 170-751
acctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagcta

SEQ ID NO: 157447 - DNA, 10084 bp, Homo sapiens
  Payload ID: 10859
  Gene Symbol: NQO2
  Gene Name: NAD(P)H dehydrogenase, quinone 2
  Uniprot ID: P16083
  ENST ID: ENST00000380455
  CDS Start-End: 175-870
ccggaacctggcgcaactcctagagcggtccttggggagacgcgggtcccagtcctgcggctcctactggggagtgcgctggtcggaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccagggtaaactagcgctcctttccgtaaccacgggaggcacggccgagatgtacacgaagacaggagtcaatggagattctcgatacttcctgtggccactccagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctggggatacttttttctttctgttttttgtttgtttttaattttagctttaaggagcacatggccagtactgtttcaggggaatattgggtggcgctggggtttgggcttctattgatcccatcacccaaacagtgagcatagttcccaatagatagtttttcaacacttcctttcctcccttccttcccgcttttggattcccagcatctattgatcccgtcttttcacccctgtgtacccaatgtttagttcccacttataagttagaacatggggaatttggttttgtttctgtgttgattcacttaggataatgacctccagctgcatccacgttactgcaaaggacaggatttcatgtttttttatggctgcatagtattccatggcgtccgtgtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcactcactgagattttcttttctttctttcttttcttttctttcttttttaaagagacagagtttcactatgttgcccgggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgacagtttctatttttcatagaaaagttgaatctgggcctgttgcttaattttcttctttgtctttttaaatttacattaggactatgaagttttaattgaacagccattaacatatatggttatatgttgcatgatgtttcaatcagtgatggactgcatgtacgatggtggtcccctaagattataatgccatgttttgtttattaaaatttatttaagatttattttattatttttatagatgaggtctcactctgttgccccagctgggtgcagtggcatgatcatacctcactaggctcaagtgatcctcctgcctcagcatccctagtaactaggactacaggcacatgctaccacgcctggctaattattttaatttttggtagagacaggatctcattatgttgcccaagctggtcttgaactcctggtctcaagcagtccacccacctcagcttccccaagtgctgagattacaggcatgagctgcctgcacctggactaatacagtaattttactgtaccttttccatgtttagatacagagatacctattattgtgttacagttgcctacagtattcagtacagtaacatctctacaggtttatagccaagggcaataggctctaccataaagcctgggtgtgtagtaggctgtaccatctaggtttgtgtaagtgcattctatgatgtttgcgtgacaatgaaatcaactaattatgaaatcacttaatgatacatttctcagaatgtatctcttttgttaagtgaaacattacaaaatttatttttttgggcacagtggctcactcctgtaatcccagcactttgggaggccaaggcgggcatgccgatcacgaggtcatctcctacaggcagtgcacattgactaagttcattccttgcttttgctgttgtttgctattataaataggattttgtcttcaattatatcttctaaaagttcttttgattggtaaaagctattgattgctgaatattggtttttgaccccgaccgtttgctgttttctcctcctaatcataattttttcttagttggtttccagtaataaagtcatgttgtctgaggccgggtgcggtggctcacgcctgtaatcccagcactctgggaggctgaggtggcggatcgagaccaccctggctaacacagtgaagccctgtctctactaaaaatacaaatatttagccgggtctggtggcgggcgcctgtagtcccagctacccgggaggctgaggcaggagaatggcgtgaagctgggaagcagagcttgcagtgagccgagattgtgccactgcactccagcctgggtgacagagcgagactccgtcaaaaaaaaaaaaaaaaaattaatggctgggcactgtgggtcatgcctgtaatcccagcaatttgggaggctgagatgggataactgcttgaggccaggagttcaagaccagcttgggcaacataatgagacccatctctacaaaaaatttaaaaatatacattagttaggcatggtggcacgcacctgtaattccagctactcaggaggctgaagcaagagggtcacgtgagtccaggagttcaaggctgcaatgagccatgactgtgtcactgcactccagcctggatgacagagcaagactctttttaaaaatagccaggcgtgatggctctcacctggaatcccagcatttttggaggctaagatgggcagattgcttgagttcagcagtttgaggccagcctgggcaacatggcgaaaccccaaccctataaaaaaaaaaaaaaattagccaggtgtggtggcacacatctgcagtcccaggtacttgggaggctgaggtgagagaatcgctcgagctgggaggcagaggttgcagtgagctgagatcacaccactgcactccagccttgggtgacggaatgagacctgtctcaaaaaacaaataaataaataaaaataatttaaaaatcattaattgccagttacaatgaaaatttaaaacttttaaaaaatttagtctgatggcattgtaccactgtgccgtgttcacgtaaccctactaataatcaccctgacacacagccacatgcagatggaggaacttccctaaaagcaagtttgagggattaaatatcatctttgtcatcatatcctcctcttttcccttttcctcctcctccttgtcatcactactgaggacagcactgctggctgtgcccaggggcccttcttcctcaacgcccccagcaccacccaaagtccccctctgtggaatcggagcactgagtgtgttggcctcagggacactgaaggaagccgcccgcccgtcctctcagccttggagtctgttcaaccattatcattcaaaccaccttccatcaaaggtttgaatacaatgagcagctgctcctgcattcctccaggacacaggttcaccagctgggtgtctgtcaaagacaatgagcctccgagttggtccaaacttgactctccttgaaggtcttctctggccatcctcaaaatccacaggatgaaatgtgttcgatgaggacaactcactcgtgtcgcggcgtttggatgggctgcggcgtggccgcttctgccgtagagacggagccttcctgtggttcgcgcacttccttcctgaagcctcatatttcccattccgttgatacttggccacctcaacctgcaacgtgcagtttccagtgtcatcttcatccaaatgcatgaatgcaagatccacagcttccctcttccaatgatcgcacagcctgtctcctttaagatgtccttggttatctctgtaaaacttgaccttaagttcttctgtctggggatcgctcataataatgccaaatggacaggcgtgtgaatgcctccacggtaacgaccagaggcaaaccggcacatacacgtttgtatttctccttcttcagcatgaagccttcctttttctcccctctttgtgggatcagtgggtttggggtttttcttggtggcagagcagcgccgtcaccgagcagccgtcgctggcctgatatgcagcggtgaagtcttcactggtttctcttctgctcctgtgtgcttgcagaaaccgggctggctcttgattgggattgtaggctgcagaggctggggaagggcagacagcctcgggagacacgccggaaagggcggctccctcgtgctcctcagtgactcagggttttggccacatagctcccctcctccaccctcgctcagcaggctgcatccggggcggggctggcaggcaaagaggctgtgtcacagcccttcagagcctcaagctggggtccctagggtttctggacctcagatcactgtgaggcaggaggtcctccaccctccctccggcaactctgaagtatgggaaggtgcgttctcgaactgccgaggggcctgttcctgtgtgggttgagaggatgggaagttgctgaaatccaacctctctgagagccggtgctgtcaccttggcctgagtatgctgaagacattaattccggttcccaagcaaaactgttagcaattcgagggctgggctcttgcctatgtctcatctcctgttagtaccgggcaccctgatacattttctgccggtttttaagaatttttttttgagacggagtttcactcttgttgcccaggctggagtgcaatggcgcgatctcggctcacctcgacttccacctccctggttcaagcgattctcctgcctcagcctcccgagtagctggaattacaggcatgcgccaccatgcccggctaattttgtatttttagtagagacagggtttctccatgttggtcaggctgaactcacccgacctcaggtgatctgcctgccttggcttcccaaagtgctgggattacaggcatgagccaccgcgcccggccggtttttaagatcttattgctgaaaaacttaaaataaaaaataaattcagtatcagcagggcagcaggaattgccattaaaaaaaaaaaaagaaaattggaaatgactgcagccaggtgtgtgtgattgggccccgcgacctttttcttaggcaaacagggctttgtggatgcagaaagacttctttggttgtgtagtttgtctcagagcctctcgtgggtggagcctggtaaaaagaggaaagagactcatgttgctcaatgtgaggaagcaccaggaattttggagaagttcccagcagctcaggagagtggctggtgccttgtcccaggggagagggaaataagcacaggcctatttctttctcaagacggaaaaaccgagccccagaaaatggcgataagatggggatgcaggaaaaagctagctaatgaacagttcagcagtgggcaccgtgtgggaacctctcctaagccgccctccctctgatggatgcatgctcaagtgatttcgttggcccttaaaggaaagtgttattccatcctgtaatcctagcactttaaaaggaggccgaggtgggaggatcacctgaggtcaggagttcacgaccagcctggccaacatggtgaaaccccgtctctactaaaaaatacaaaaattggccgggtgtggtggcatatgcctatagtcccagctacttgggaggctgaggcaggagaatcacttgaacccgggaggtggaggttgcagtgaggtgagatcgtgccattgcactccagcctggccacagagcgagactccatctcaaaaaaaaaaaaaaaaaaagacatctgcccaagggtcatagctgtagaggggcagatgtggtttgaacccagggcgtctggttcctctctggaagcaaccaaagtgcctgtgattggggtagtgacaaagcactctgagccgctgcatggcagatgctgtgaagagtcatctttgcctgtcccatatctattcccattttttctgattgtaacaccttgtttttttgtgtgtggtgggggaaccatgccctttcaaccaagctatgtggtgttcataagggtagcccctcctccgaccccaggagtggcagttcacagccctgactgatcacagtgttccgtggcctagctgtaaccaccccagggagtgagactgaactcaggggttcattggacctatcaggaaagagagacctttcttgtttctggacttggagctgtgatgaagtaagtgggtcaggggccaacacatagacagcgttggcctacaaatgcagcccaggcagaggacggtgcagccaagccacacagagagacaacttcctagtgacacgctgtgaactcctgcatccacccctgcctgaactggagcttttcctcttcagctcttcagttatgtgaggcaagatgttgccttttttgcttaatgctgtgagttgagtgtacagcagttacaatcaaagaatcctaaataatgctgcaagcatggtgactatctacatgggaatatgcagtactccagtgaagacaaaacataaattaattttggaatctgatgaccataatctaaaaacattcatagaggtatataaaaattataacaaaatttaaagtagcatatctcctcatgaagcaggttaagtgtatacacaaagaaggaggaggaaaaggtgagaaagaatctgcccttgtggggaagtgacagaggcagaagaggctgatgcagtcctgcatccaggcccagctctgccagcagctgagtacccctgaacaagctcccccacctcttcgggcctcactttccccatctatgaaagaaagggagtctagcttccatagctgccccagctgatacgcaaggtgccagtgtgtcctcagtcctgtcaggagaaaccttccccactagaatcccaggaggagcttgaaatcctgtctgggatcctgacggcccaggtgctgaccctgcctcgggttgtgtctgctaagaagtctgatttctgctcatctctccccatttctttcttcccataaagtgggctgatgcgctggaacgtcgatgcagccagtgatgtgtttgatgagaatgtattgagagtaaagctgcccagaatccaagtgtgtgtcatctgaactcttgaatcatggatggaaggtatgtcctctgttgatgtctcgcagcctgagctgacaatctgtaagaaggttttgttatcttcatgttacagatggtgaaccgaaacttacagagctcaagtcacttgaccaggctccacccctacaagaggcagcacgcaaactaaaaaccaggcggccttttccaaagcttgtgctctgctccactgctggaaggaacccttcggggaattgaagcagcactgaacaaaggccatttttaagaagcgacaccagaaacctaaggcggggtccccggctcaacaaggatctcatgttttgtgggtcagagattcttgtgtcgtgtctgggtgaggtcaaaaaccatgcagagactttcacttcctgttctgtggcagacaagacatctgaaaagctctcctgcagcaacacttctagatgccaagtaaatcacagcaagtgcacttttaaatgtgttactaagatcataaaaatgaaggaaaatgcccaagcatatccccaacccctcaccccacaaccaccaccaccacaataaacaagttgctgacagtggattggcaagcgagagtggaaccttaggctgcgttggcatcaaatactaataaccaagcaaaagggagcaagaccaggcctgggggctgtgccattgagaggtgaccgcgtgctggcagtcctcacagccctcgttcgctctcggcgcctgctctgcctgggctcccacttcggcggcacttgaggagcccttcagcccgccgctgcactgtgggagcccctttctgggctggccaaggccggagccggctccctcagcttgcagggaggtgtgcagagagaggcgcgagcgggaaccggggctgcgcgcgacgcttgcggggcagctggagttccgggtgggcgtgggcttggcgggccccgcactcagagcagccgggcggccctgtcggccccgggcaataagggcttagcacccgggccagcggctgcggaggatgtactgggtcccccagcagtgccagcccacgggcgctgcgctcgatttctcgccgggctttagctgccttcccgcggggcagggctcgggacctgcagcccgccatgcctgagcctcccccactctccgtgagctactgggcagcccaagcctcccccaagagcgccgcctcctgctccaggcgcccagtcccatcaaccacccaagggctgagaagtgcaggcacagggcgcgggactggcaggcagctccacctgggtgaagccagctgggctcctgagtgtggtggggacgtggagaacctttatgtctagctcagggattgtaaacacaccaattggcactctgtatctacctcaaagtttgtaaacacaccaatcagcaccctgtgtctagctcagggtttgtgaatgcaccaatccacactctgtatctagctattctggtggggccttggagaacctttatgtctagctcagggattgtaaacgcaccaatcagcaccctgtcaaaacagaccacttggctctaccaatcagcaggatgtgggtggggccagataagagtataaaagcaggctgccctagccagcaatagcaacgaagtcggatttgtttccatgctgtgacggttttgtttttttgcttattgtaatagcttttgctgttgtactcttttctggtctacactgcgtttatgagttgtaacagtcgtcacaaaggcctgcagctttcactttctgcctcagccagcgagactgcaaacccaccaaaaaaaaaacttaactgtcacacccaccctaagggtctgcagctgggtttttgaaatcagaccaagaacccaccaattcagaacccaccaattcgggacacaccatgtgggcagctgaatcaagactttgtggaggagctccaaagtgggtagaaaagtacgttcacccttacagggagactggcaggcagcctttttccttctcggtagaaaaataaactcctgttccataga

SEQ ID NO: 157448 - DNA, 689 bp, Homo sapiens
  Payload ID: 10859
  Gene Symbol: NQO2
  Gene Name: NAD(P)H dehydrogenase, quinone 2
  ENST ID: ENST00000380472
  CDS Start-End: 273-689
gtaggggaggcggggctggagggagatggcgccgcgctcccggatgaacagagaaagcgacaggataagggcctcgctctgttacccaggctggagtgctgtggtgtgtttgtgactcaccgtagccttgaactcctgggctcaagcaatcctcccacctaagcctctggagtagctgggactacagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccag

SEQ ID NO: 157449 - DNA, 833 bp, Homo sapiens
  Payload ID: 10859
  Gene Symbol: NQO2
  Gene Name: NAD(P)H dehydrogenase, quinone 2
  ENST ID: ENST00000397717
  CDS Start-End: 417-833
gcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaagctttaggttcattcttgtaagtgttgctggtgtcagaataggaacctccctgcgctttgaagggatgaatgtgacctctcccacattctccggtgctgtgatgtaccttaaacacagcaagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctgaggttttcaattatggagtggaaacccacgaagcctacaagcaaaggtctctggctagcgacatcactgatgagcagaaaaaggttcgggaggctgacctagtgatatttcagttcccgctgtactggttcagcgtgccagccatcctgaagggctggatggatagggtgctgtgccagggctttgcctttgacatcccaggattctacgattccggtttgctccag

SEQ ID NO: 157450 - DNA, 626 bp, Homo sapiens
  Payload ID: 10859
  Gene Symbol: NQO2
  Gene Name: NAD(P)H dehydrogenase, quinone 2
  ENST ID: ENST00000426637
  CDS Start-End: 437-626
caggggaatggctgtgacaataaataagattgggaaaacaagaagacgcccttgcatacattaagatatgtatatatggaaatgttaccgggagtcccggttatcccaaaaagggttgtttcctgttgcgtggtgaggccaatgcacgaaaccgaaagggagtgtgtcaagcagtgcaggctgtattcaatggctatggaattggaagatctgaaatcaacttagcttataagggcctcgctctgttacccaggctggagtgctgtggtgtgtttgtgactcaccgtagccttgaactcctgggctcaagcaatcctcccacctaagcctctggagtagctgggactacagattgctggactcgctgaagagagactacgcaggaaagccccagccacccatcaaatcagagagaaggaatccaccttcttacgctatggcaggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactggtactctttctaatcctg

SEQ ID NO: 157451 - DNA, 470 bp, Homo sapiens
  Payload ID: 10859
  Gene Symbol: NQO2
  Gene Name: NAD(P)H dehydrogenase, quinone 2
  ENST ID: ENST00000606474
  CDS Start-End: 179-286
ttctgctgacacctcactggccatctcaactgcaaggcagcctaggaaatgtagtgcttacctgtacacgtggattcctggaatcaattcaggattgctggactcgctgaagagagactacgcaggaaagccccagccacccatcaaatcagagagaaggaatccaccttcttacgctatggcagaatttaggttcctcaaaagtggggccctgcctatcctgtctttgctgtgcctccaggccctgaaattctccctgggctgtagcaggggctcaagtgaatgaaccccaggaggcatcttgggtaagaaagtactcattgtctatgcacaccaggaacccaagtctttcaacggatccttgaagaatgtggctgtagatgaactgagcaggcagggctgcaccgtcacagtgtctgatttgtatgccatgaaccttgagccgagggccacagacaaagatatcactg

SEQ ID NO: 157452 - DNA, 766 bp, Homo sapiens
  Payload ID: 10860
  Gene Symbol: NDUFA1
  Gene Name: NADH dehydrogenase (ubiquinone) 1 alpha subcomplex, 1, 7.5kDa
  Uniprot ID: O15239
  ENST ID: ENST00000371437
  CDS Start-End: 426-638
tttctccgggctctgggtcgcaggccgggcgctttctgcgtccagcagcccctttccgcccaggctttttgaaaaggaaggtgcacacctgatccaccgcctttcctggagaaagctgctctgccattttagagtcctgagctccgaaacagccgtggctgcctgggttgcacttggcccctgcacgtcactccacgttgcgcgctccgccgggagtcgaagcaaaagacactgacggaagaggactgcgagagcccgagcgcccgtctctcttgtgccctagcagattccgtcgcttcttccggagccgtacgtggcaccgccccgctcgcgggcggccgcggggcttgctgggaagagaggcgaagccaggtcacctttcaaggacccagaagtagggttttggcctaggtaacggggcagagatgtggttcgagattctccccggactctccgtcatgggcgtgtgcttgttgattccaggactggctactgcgtacatccacaggttcactaacgggggcaaggaaaaaagggttgctcattttgggtatcactggagtctgatggaaagagataggcgcatctctggagttgatcgttactatgtgtcaaagggtttggagaacattgattaaggaagcattttcctgattgatgaaaaaaataactcagttatggccatctacccctgctagaaggttacagtgtattatgtagcatgcaatgtgttatgtagtgcttaataaaaataaaatgaaaaaaa

SEQ ID NO: 157453 - DNA, 4915 bp, Homo sapiens
  Payload ID: 10861
  Gene Symbol: NDUFA10
  Gene Name: NADH dehydrogenase (ubiquinone) 1 alpha subcomplex, 10, 42kDa
  Uniprot ID: O95299
  ENST ID: ENST00000252711
  CDS Start-End: 102-1169
gcaccccggccgtgacgtcacggcagcgcgccggccgcgagagagggccccgtcgcgaccgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaatttccccatcgtacgtctatgtgcgtgcgggcacgtcgaaactgcacacgtgcacacacgctgctctgggccctgtttggtgtggtgtggtttaattgaggcttacattatgctgaagagtttttctaaaggcctactgtatttattttagtaatgtgctacattagagtagaaaaaataagaacgtgaagaagaaatagcaaaaggagaaaattaccacagatttacagaacaatatgttttaagagagacgttgagaaagattcacgtggccgtcctcagcgtctcaaactcctttgaagggagatttgagcttaggctgttgatgacataagatgcaaaagcaaaataatatactctctttattacccagaaaatcaagttgccagtcaaaactgagaaatgagaaagaaaatcagatttctttattcatctctgttgaagcctagaaaaccaaaacaagctggttgtggttcagcatcatggtttaggaatcaagctgtcagttgtgagtcctactgaactgtgggttttccactgtaaagctccactgtgtccattaggaatcaggctgccagttgtgagtcctactgaactgtgggttttccactgtaaagctccactgtgtccaatatggtagctcctagccacatgtgggtattgaaatttaaatgagctaaaatgtaatagagtttaaaattgggttccttggttgcactggccatagttcaggcactccacagccgcctgtgggcagtagttccagtgctggtgcagaggacgatgctctgctccccgcggaagctctaccaggcctcgctgctgcggagcatgcgaagaagatgcacactccttccctccttgcgtccgcctgcctttttccctctccccttccttccctccttctttcctcctccttccctcccttcctttcttccttccatctgtccttgttttcctcccttcccttcctccctgcctctttccttccctccttctcttccttccttccgtctgtccttgttttcctccctgcctctttccttccctccttctcttccttccttccttccgtctgtccttgttttcctcccttcccttcctccctgcctccttccttgttttaagaatttgaaaataaagtttcccaggagttttgaattggagtcgagatttaagtggctgaagttttgcatttcactaggaaaccaacagctttaatcatgaaatgaaagcacagctgggcattgggccagtcacagagtgtcttttgctctgagcacttcacaaacccattgtggaggggaggaaagaaaaagaaagccatctttaattatcttagctgttcctaatgtctttggctgcaaagagctagctgtttccttcaaccttggtggttgcacgggtagtgtcctcagcagtgagagggcaggtctgccctgtggtcaggattgcccttgtgaggggcagagctctccaaccatgcagggctccgtgtcggcatggtgtggactcgggtgctctgatcatcccctgtgtttgcgtctgaccctgtgtggttgcattcccttgatggagtgggaagtatgtaatttgtagtgctgaggacattcgtctgtttgattttctggtgttttcaatgacatgcatgttcagcagagaaagatgaataaacactgtccaattcttctctccacatagaagcctcaagaagaggtgaggagatgccccgatttccttatttcagagcagtacatgcgttcgtctcacgaaagctcttacaactaaaacaacagcaccaacaaaccaggatcaaaataatcgtgcattttccaggattccatgttggacttctcagtgctttggagatcaggaaataatcatgctgttgcagcagtatggttttgtgtctggattttattcatacaggcatgtgtttacaggcatgagaattctgtattgaaaagaaagtccttgtttttttctaacgtatctttctgttccatcaactgttaaaaccaaattgttaagaacattgagcttcttaggagagattacatgcagctacttaggaccacctcagcaaaatggagttgcctgggtagatagcagcagcagctcaccagccccacgctgccaggctgctggctgctgtccaccaggcagctgtggaacctccatgttctgcctaggtgttgtggcaagaacagcagggaaacaggcggccgcctccaggccacaggtggacccagggaccttcagttacgccgcttcaattgaattcgtggtggtttctctgctacagcagaagtggaagaagctcttgtcttgtttggcatttgtcccattttttggctaataattggctttgaatttctctgtgccctgcttaccaattatagctttctggattggctgttcttagcagtgcaaatgtcaatgcaaagaagcaagcaggcggctactttctgggaagaagcatagtccgtgctcacactggatataaatctgcaagatttgggggtttggcaaaataggggtggagggaaagctgccatggctgtcagaaattggggctttttgaagaaaagcttgtgtaggcatcagccactggctggccagaattccatgaatggaagcaggtgcccgagtgatctggggctttacatgtggatataaatagaagccgggagcctgaggctttgctttaggaaaatcatgagccagaaaacagaggaggtgattgtcagtagtcacctcacgccgctagtgttttctaatactctctcgaattgtcaaagcaaaggaccttataacagcaacacgtgtgtgactcgaagcagcgagcttcccttgggaaaaggagcctcttctcagcagagggtcccagcctttctgtccttccccatcggaatgccaggctctgtgagtttggatgttggacattgccacctgaattccaggaggccggggagctccagtgatggacttgtccccaaaagagtggtgctgttctcagagccataaatgttccactgaaagtgtctgtcccctggctcacgctggctgcgcttgcttgaaggaggctgatttaagggttctaataggaagacaaatgaaactgtcaaattttatctttaagcatgtgagtaagtttgctcattcgcttttactattgatgtatagttttaaaattcttaatttaaaaattattttaatagtaaatttttcacaagtgaacactttttatctttaaattaaaattctgaagctccctagttagttagatccaattgctggttacattttgggaagctctcattttagtgctatgtagtttcattgaataaacatgtttttaatgaga

SEQ ID NO: 157454 - DNA, 1313 bp, Homo sapiens
  Payload ID: 10861
  Gene Symbol: NDUFA10
  Gene Name: NADH dehydrogenase (ubiquinone) 1 alpha subcomplex, 10, 42kDa
  Uniprot ID: O95299
  ENST ID: ENST00000307300
  CDS Start-End: 24-1313
gatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgagtcagcattgcagacccacttctggactggggtggctggagccagtggaaagctggaatctgggagctcagaggaagtactgttgattaatgaaagaggaggccgaagcaagccaggtgtggaccactacaacgaggtgaagagcgtcaccatctgcgattacctgcccccccacctggtgatttacatcgatgtgcccgttccagagccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagcgattagattggactgtgtgttttggggaggaatccacagaggtgaagcatcaggggcacttgctgtcagtgcagcctggcaccgtggccctgaccgtgggctcctggctgaggtcgtgcttgctgggtctccactggaagctgctcttcctctttccagaaagccccatgcacaccacagcctttatgttcctttgttga

SEQ ID NO: 157455 - DNA, 699 bp, Homo sapiens
  Payload ID: 10861
  Gene Symbol: NDUFA10
  Gene Name: NADH dehydrogenase (ubiquinone) 1 alpha subcomplex, 10, 42kDa
  ENST ID: ENST00000407129
  CDS Start-End: 7-612
gtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgagtcagcattgcagacccacttctgggtgtgtggtgcgactttgcaagggctgtgatagactcaccttgcacttactgtgtttatgaatgtctgttagatagatgaataaatgccattacttaatcggtctccgctggaaaaa

SEQ ID NO: 157456 - DNA, 1557 bp, Homo sapiens
  Payload ID: 10861
  Gene Symbol: NDUFA10
  Gene Name: NADH dehydrogenase (ubiquinone) 1 alpha subcomplex, 10, 42kDa
  ENST ID: ENST00000404554
  CDS Start-End: 6-1178
tagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctggggatcccctacccgcagcgggctgtgcagagtacaagagagggtcctgaagtgcttctcactggtctttggaggtgggaagaccttctcatcggtcttcagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatgggaa

SEQ ID NO: 157457 - DNA, 562 bp, Homo sapiens
  Payload ID: 10861
  Gene Symbol: NDUFA10
  Gene Name: NADH dehydrogenase (ubiquinone) 1 alpha subcomplex, 10, 42kDa
  ENST ID: ENST00000414580
  CDS Start-End: 13-297
gaccgggtagccatggccttgcggctcctgaagctggcagcgacgtccgcgtccgcccgggtcgtggcggcgggcgcccagcgcgtggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggtgcagtatttctgggcagttagatctgttctgtacttgaacactattctagaattcaaccacgttaaattgccactgagtcgagctttcctttaagggtgtttgatgaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctg

SEQ ID NO: 157458 - DNA, 621 bp, Homo sapiens
  Payload ID: 10861
  Gene Symbol: NDUFA10
  Gene Name: NADH dehydrogenase (ubiquinone) 1 alpha subcomplex, 10, 42kDa
  ENST ID: ENST00000444548
  CDS Start-End: 1-400
ctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagaggtcttccaagaatcagaagccaagagattagatgtcgaagaggtctgttggaagaaaacacctttgaaggatcggggagaggaagtctgagatggcaggagagcctttgctcttccttgcgggactgtgacaagagacaggaagaaagaatccaggaaagatttggccaggctgatgagtgtcctagagccaaagatgcctgtcagggagtcccatgtccacaggaacagctggcaccagaagctcttctgtgctccatcactgaccaggcacattctgtaacgtgcgtggccgtggcatgaacaggcagc

SEQ ID NO: 157459 - DNA, 662 bp, Homo sapiens
  Payload ID: 10861
  Gene Symbol: NDUFA10
  Gene Name: NADH dehydrogenase (ubiquinone) 1 alpha subcomplex, 10, 42kDa
  ENST ID: ENST00000419408
  CDS Start-End: 1-390
gacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagaggtcccagcagaccaggagcacagatgggtcagcctactcagttctccactgggctccctgttctcagaatggtctgtgtgtggagaagactcctaagtgcctgggaataggtgggctgtgggtgaagcggatgaaggcgatacagagcgaggacgtggcctgaaaccgagagcagcattctcccttccctgcttccatccgttcctggtctgcgtcccagccctggtacgtaaggctgtcccagaatccctgtaaattcacttttctgttaaatgattccagatcattcggttatgtgcaaccaaaagtcctcacccatacgtcatcttacagcattaaagcttcaggcgacttgggtatgttttaaa

SEQ ID NO: 157460 - DNA, 434 bp, Homo sapiens
  Payload ID: 10861
  Gene Symbol: NDUFA10
  Gene Name: NADH dehydrogenase (ubiquinone) 1 alpha subcomplex, 10, 42kDa
  ENST ID: ENST00000448880
  CDS Start-End: 1-417
gagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagttcagtctcttcaatggaaggaagccagatgctgttaagatactgtgctccctccttgaagctgatcgttccctccttgaagctgatcgttccctccttgaagctgatcgtgtccaagatagttgctaggacaacagaatcttctg

SEQ ID NO: 157461 - DNA, 776 bp, Homo sapiens
  Payload ID: 10861
  Gene Symbol: NDUFA10
  Gene Name: NADH dehydrogenase (ubiquinone) 1 alpha subcomplex, 10, 42kDa
  ENST ID: ENST00000443626
  CDS Start-End: 43-776
cgcgtccccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagttgaaaaatgtgaggttttacaatattctgcaagggaagctcaagattcaaaaaagggttcaggataagtttgaggtgctgaattacacaagcattcctatctttctcccggaagtcaccattggagctcatcagactgaccgtgtcttacatcagttcagagagctgccgggccgcaagtacagccc

SEQ ID NO: 157462 - DNA, 1489 bp, Homo sapiens
  Payload ID: 10861
  Gene Symbol: NDUFA10
  Gene Name: NADH dehydrogenase (ubiquinone) 1 alpha subcomplex, 10, 42kDa
  ENST ID: ENST00000620965
  CDS Start-End: 45-1112
accgcgtccccttgggtccttgatcctgagctgaccgggtagccatggccttgcggctcctgaagctggcagcgacgtccgcgtccgcccgggtcgtggcgcgggcgcccagcgcgtggagaggaattcatagcagtgtgcagtgcaaactgcgctatggaatgtggcatttcctacttggggataaagcaagcaaaagactgacagaacgcagcagagtgataactgtagatggcaatatatgtactggaaaaggcaaacttgcaaaagaaatagcagagaaactaggcttcaagcactttcctgaagcggggattcattatccagacagtaccacaggagatgggaagcccctcgccaccgactataatggcaactgtagtttggagaaattttacgatgatccgagaagcaatgatggcaacagttaccgcctgcagtcctggttgtacagcagtcgcctgctgcagtactcagatgccttggagcacttgctgaccacaggacaaggtgttgtgttggagcgctccatcttcagtgactttgtgttcctggaggcgatgtacaaccagggattcatccgaaagcagtgtgtggaccactacaacgaggtgaagagcgtcaccatctgcgattacctgcccccccacctggtgatttacatcgatgtgcccgttccagaggtccagaggcggattcagaagaaaggagatccacatgaaatgaagatcacctctgcctatctacaggacattgagaatgcctataagaaaacctttctccctgagatgagtgaaaaatgtgaggttttacaatattctgcaagggaagctcaagattcaaaaaaggtggtagaggacattgaatacctgaagttcgataaagggccgtggctcaagcaggacaatcgcactttataccacctgcgattactggttcaggataagtttgaggtgctgaattacacaagcattcctatctttctcccggaagtcaccattggagctcatcagactgaccgtgtcttacatcagttcagagagctgccgggccgcaagtacagccctgggtacaacaccgaggtgggagacaagtggatctggctgaagtgaacgggccgccttctgctccagctgcatcacagtgatggccaagctgcatcagccgcactctcctggacgccatatagctttaagatcgggggagggtaaataatgcaaaaattgcacagtggaagaaggggtctcacaaaaagcaatccatcctgtagtataggtaatggagttgggggaagcagcttccattctggatgtttggaaccctttagctttgttttggaatggcccaccattctcactggaaaacagtggtctgctgtgaaaggccagctctcggcagcccctgtggtttcagcgctgccgctctgtgtcattcaggttgtgcacattgtttttcttctgacttccagaaataaaagtgtttccatggg

SEQ ID NO: 157463 - DNA, 539 bp, Homo sapiens
  Payload ID: 10862
  Gene Symbol: NDUFA11
  Gene Name: NADH dehydrogenase (ubiquinone) 1 alpha subcomplex, 11, 14.7kDa
  Uniprot ID: Q86Y39
  ENST ID: ENST00000308961
  CDS Start-End: 49-474
gcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtg

SEQ ID NO: 157464 - DNA, 2406 bp, Homo sapiens
  Payload ID: 10862
  Gene Symbol: NDUFA11
  Gene Name: NADH dehydrogenase (ubiquinone) 1 alpha subcomplex, 11, 14.7kDa
  Uniprot ID: Q86Y39
  ENST ID: ENST00000418389
  CDS Start-End: 79-765
ctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcaagacaggatctcactgtgttgtgcaggctggtctcaaactcctggcctcgagcagtcctcacacctcagcctcccagagtgctgggattataggcatgagccactgtgtacagagattctgggtcccttcttccagcgcctgcctcgaagtcctctctggagagagcacagatgtccacgcgtgttccagcacaaggggggcatgcaacagctcagggtcacgtccacttccggagctgggtgcccgggcctcgggctccctgagaaagggcggacacacccaccccgcacccagaggggcaggggccctgacacctgtccaagccctaatagagtcattgttaaacactctgggttcgaaccccagaacttgattctttccttgttctgtcctcagaggacggcagcacccaggcctcagctttcccacctggtaaatgggaataagggcccctcagagatgccccacaaagaaagacgattccacctccctgcaggcatcccatccactcacgggcatcgcatccactcgagggcaccggcctctgtctctactgcggccggcagggggcagcgcccaccacagcacggcctgctgggcagtgtggacccgggcggtcatccccaggcccccagccccgcggtgaccacaggcgtcagattccatcccttcctccgcactccaggccttgtctgtccctcatcccccttccttcccatgcatcctgcccaccgcagccgggaagtgatggcttctaggaatgggcaatacagccccaaacctccagccaaggacaccgaaggctggacaggaggaaagactagtccacgtccccacgacggtcaccctcagccctgcaccatggccgcttctgggactggttccacgcaggcctccgccccctgcaagcccttccccggccctccaggcccgtgtgcggcccaaaccctgtaccagatctcttagccctcttccacggatgcgcgcgctgaggcccaccctgggtagtggagcttgaaatttaaaggccgcacgccccttcgcacctcccagccccaggtgcctccctgtgttcaagggagccgacggctcagaccaggagctgtgctcgccgcccacccagcccattccgggctagccgccagggttggcgcaggcctgccaggcgcccccacctcgcctgcaggacgggccccccagaatggaacacgagggggtggtctcttgctgggctccagggaaccccaaagccgaggccccccggcccataaacatttactaggttgtggagggctgacgtcactcccaccccacacacaagagggcccccgtctggaacatcggtcccagcaggctccctgaggggctgtgggggacccttcctgagtttaccttgaacttcatggagcccttcccagccccaggcagtcagggctggaactgaggaggggcagagcctccctggggagctaggagggcttcctagaggaggaggcggcacagcagagagggcccaaggatgaagaggcttttccatgtgtacccagcgggaggctggtccaggcagagcacacagcaacagcagaggcctgctgtgagggagagcagtgggcgatcaggggcctcctggtccaggagaggtgcctgggggctgcagggcacacacttgcttcccgagaatccatccctggagacacatccccagcagagacaaggctccaagaacaccggcctggccctgcgccgtggctcaggcctgtaatcccagtactttgggaggccgaggctgggggatcacttgaggtcaggagtttcagaccaccctggccaacacagtgaaaccctgtctctactatacaaaaataagccaggtgtggtggcaggcacctgtaatcccagctacttgggaggctgaggcatgagaatcccttgaacctgggaggtggaggttgcagtgagccgagatcatgtcactgtactccagcctgggagacagtgagcgagactttgtatc

SEQ ID NO: 157465 - DNA, 657 bp, Homo sapiens
  Payload ID: 10862
  Gene Symbol: NDUFA11
  Gene Name: NADH dehydrogenase (ubiquinone) 1 alpha subcomplex, 11, 14.7kDa
  ENST ID: ENST00000593233
  CDS Start-End: 47-154
ttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggtagggactgaaggttggagaagcatattaactgctccagggtcatttgaagctgggctgcaagtccaggtcggctgacctgctcctaggggtctctgaagcaaggaatgttcccatcaggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtg

SEQ ID NO: 157466 - DNA, 2154 bp, Homo sapiens
  Payload ID: 10862
  Gene Symbol: NDUFA11
  Gene Name: NADH dehydrogenase (ubiquinone) 1 alpha subcomplex, 11, 14.7kDa
  ENST ID: ENST00000592634
  CDS Start-End: 64-426
cgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcagtgagtggccccctccccacccccaccctcctcccagcctggcagaatgacccctgacctctgctcatcctccaccctctctgttccatcccggacaagaagtaaagcagccttcttgaacaccagccatttcagtcatagcgacagctgctgctgctgcttaagcacctactgtggccctccctgacctgccctgtcccctccccaccctcccctcctcactctgctccagccacacgggcctcctcactgctcctcccacatgccaggtacagtcctgccccagggcctttgcatgggcagtgcactgcgtggaatgctgttcccctcactgtcctgaccaccctgtgtacaagccagcatccccgccgccctcgctctgtgccgccttccttctgtgtgccttgtcagaggacacaggtcaccaaggtcaccccctgtctctgccactggcctgtgagtcagagaggaggatggatggagtctcgccctgccatctctctccctgcacctggagccctgcaggggagctgcccccgcaaccttcactttacagaaaagggtattagggctcagggagggaattaagtggcccgaggtcacctggaggagcaagtggccttctttgcagccatcagagggtgcagccctggtggagaaggccacgcttggcacaggggagcccgtctggagcatgagccagacatcactcctgccctcccatgggcccgggctcagcgtcagtgcccgcctgtgcccctggcctacccccagcccgccaaggctcgggccctcagggccagcgggaggagtgaacgagccctcttgcagctcagccgctctggcctggcatgttgggagtgatgaatggcaggttccaggcaggcagagagggagggtgcgagggcagggcgtacgccgtcactgctgtctctgcgtcaagaccttggggaggccttgtccctccccagctcccactggaactggtcagaggttgcaggtgggttgaggtcttgactgtagcccagctcaggctggaactgctccctgtccccaagccagcctccctgtctctcttcaaagagtgtgagtccctttaggtcctggtgtgtggggacacacctccttcctcctctggcccggaggcttcggagcaggagagcctggagaagtgggggcactgtcggggctcctcggtacacagaccacgggacagatgcgtggcctggccctggcatccatgggcaaaggagagactgagacacaccgatgtgtcaccatggcccggtgcccagccttgccccagccccagctgggggcagcacggtgtcctcgcagggggaagtcagtgtggggcgggatgaggacccacagcctgggttcctgctgggaagcaacctggactccggcctccctctgtgcatcagtttccacatctccagagtctagggccctcttcctgagtgacttaatccctgaagagagtgtcctgtcaggggtctcagtctggctcccagggtgggcaccggccagggcgtggagcgtcttggtccggccgagccccacccgggcctgacatcacctccccactcccacagcgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtg

SEQ ID NO: 157467 - DNA, 635 bp, Homo sapiens
  Payload ID: 10863
  Gene Symbol: NDUFA12
  Gene Name: NADH dehydrogenase (ubiquinone) 1 alpha subcomplex, 12
  Uniprot ID: Q9UI09
  ENST ID: ENST00000327772
  CDS Start-End: 91-528
ttctgggcgtgggcttcctgcggctgagtggcagcttccatccggtgggttttgctcggcgcacccgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaaa

SEQ ID NO: 157468 - DNA, 563 bp, Homo sapiens
  Payload ID: 10863
  Gene Symbol: NDUFA12
  Gene Name: NADH dehydrogenase (ubiquinone) 1 alpha subcomplex, 12
  ENST ID: ENST00000546788
  CDS Start-End: 69-368
gctgagtggcagcttccatccggtgggttttgctcggcgcacccgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggccgtcaccgatgggttgtatatactactgaaatgaatggcaaaaacacattctgggatgtggatggaagcatggtgcctcctgaatggagcctcatgggttttaaactaaaccttcatgagccagagtaacctgagcatactgaaaatccagaatcggcctctagcacctaatagtaatactgcatcgttggcttcacagtatgactgatgatcctccaacaacaaaaccacttactgctcgtaaattcatttggacgaaccataaattcaacgtgactggcaccccagaacaatatgtaccttattctaccactagaaagaaga

SEQ ID NO: 157469 - DNA, 276 bp, Homo sapiens
  Payload ID: 10863
  Gene Symbol: NDUFA12
  Gene Name: NADH dehydrogenase (ubiquinone) 1 alpha subcomplex, 12
  ENST ID: ENST00000547157
  CDS Start-End: 21-188
ggcggggccagcgaggcaagatggagttagtgcaggtcctgaaacgcgggctgcagcagatcaccggccacggcggtctccgaggctatctacgggtttttttcaggacaaatgatgcgaagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaaac

SEQ ID NO: 157470 - DNA, 813 bp, Homo sapiens
  Payload ID: 10863
  Gene Symbol: NDUFA12
  Gene Name: NADH dehydrogenase (ubiquinone) 1 alpha subcomplex, 12
  ENST ID: ENST00000552205
  CDS Start-End: 1-163
gaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggtgccctgctctgagctgctctatggagtggcctatgtggcaggaactgaagataatcttcaatgccagccagcaaaaaacggaggtcctcagtccaacatcccacaaggaaatgaattctgccaacaaccgtgtgaatgagactgcagtcttggtcagaaatgcgattgcagctttcagaagagactctggaatagaggacccaacaaacggatgcctggactcctgacccaaacccacagtaatggaatcaggacgtgcttgcccctgaaggttaaagctgatgtttgccccccaaggaaacctctttccatcaaagcatctctcaccatcatccctggcctacagagggcatccgcttttcaagaatgccaactcctctctcaccaatgtgtgttttttctgaaggttttgcttcccaaggaatggccttactgttcaaattcagatgcactaggcaagttcagaagacaagagtgaagatgagacgccaacagcctcacactgaggacgattctttctccagctccccactgcacaagcaagcttggtattcatcaatatgacatggtctggaagttttcctgtatattcatcagcttgggttactaaacaaagtacaaaatacttagtggctttagcaacataaatttactttctcaga

SEQ ID NO: 157471 - DNA, 546 bp, Homo sapiens
  Payload ID: 10863
  Gene Symbol: NDUFA12
  Gene Name: NADH dehydrogenase (ubiquinone) 1 alpha subcomplex, 12
  ENST ID: ENST00000551991
  CDS Start-End: 1-144
cgggtttttttcaggacaaatgatgcgaaggttggtacattagtgggggaagacaaatatggaaacaaatactatgaagacaacaagcaattttttgatgaagaaactgaggcccaaggaagtatctttaccaaagagacttaatcatgtaattaatggcagaacctggggccgtcaccgatgggttgtatatactactgaaatgaatggcaaaaacacattctgggatgtggatggaagcatggtgcctcctgaatggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaaa

SEQ ID NO: 157472 - DNA, 487 bp, Homo sapiens
  Payload ID: 10863
  Gene Symbol: NDUFA12
  Gene Name: NADH dehydrogenase (ubiquinone) 1 alpha subcomplex, 12
  Uniprot ID: Q9UI09
  ENST ID: ENST00000547986
  CDS Start-End: 34-225
ggcgcacccgggaggcggggccagcgaggcaagatggagttagtgcaggtcctgaaacgcgggctgcagcagatcaccggccacggcggtctccgaggctatctacgggtttttttcaggacaaatgatgcgaaggttggtacattagtgggggaagacaaatatggaaacaaatactatgaagacaacaagcaattttttggcatcgttggcttcacagtatgactgatgatcctccaacaacaaaaccacttactgctcgtaaattcatttggacgaaccataaattcaacgtgactggcaccccagaacaatatgtaccttattctaccactagaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgact

SEQ ID NO: 157473 - DNA, 991 bp, Homo sapiens
  Payload ID: 10864
  Gene Symbol: NDUFA13
  Gene Name: NADH dehydrogenase (ubiquinone) 1 alpha subcomplex, 13
  Uniprot ID: Q9P0J0
  ENST ID: ENST00000507754
  CDS Start-End: 485-919
gggagcagaatccgttccagggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctgg

SEQ ID NO: 157474 - DNA, 576 bp, Homo sapiens
  Payload ID: 10864
  Gene Symbol: NDUFA13
  Gene Name: NADH dehydrogenase (ubiquinone) 1 alpha subcomplex, 13
  ENST ID: ENST00000428459
  CDS Start-End: 10-462
actgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggtcccggctgggagggcagaggtgccagccacggcagagacagggcctggggttggggagctcccacagctttctatagaaaccccaggaccaagggggtggtgggtgccaggtcccacaagggaaggctgtagcgcctgccacgcacaggggccactgatcctgggggatgggtcctagcaggctgtatatgggtggctgtgcctctacccataccccactgtccccacaggtgggggagtctgtgt

SEQ ID NO: 157475 - DNA, 1166 bp, Homo sapiens
  Payload ID: 10864
  Gene Symbol: NDUFA13
  Gene Name: NADH dehydrogenase (ubiquinone) 1 alpha subcomplex, 13
  ENST ID: ENST00000502506
  CDS Start-End: 504-827
gggatacccatcaccaccagggagcagaatccgttccagggattggggtgagtccgacttcgagcagcagctgccccccaacatcatgtacccagcccgtgactacgtggagccctgggcttcgcgtagagtccctagacggggcgaaaacgggaaaaggggccttaactggggcacctggctcctttgagagctcggagtttctgactggcctgcgcaacaccccagaggcaaggtgaacgcgagggcctataatgcaagaaccaaggcgagtcacgccctgtctgggcaaaagaggagtaaagacccctcagctgcagcccggcagcgcattcctacccagggtccgccgccagagctttcccgcgcggtcggatagttacactactgtccgggacttcctagccgtgccgcggaccatctcaagtgcttccgccacactcatcatggcggtggcagtaagtcacttccgcccgggaccggaagtgtgggatactgcgagtatggcggcgtcaaaggtgaagcaggacatgcctccgccggggggctatgggcccatcgactacaaacggaacttgccgcgtcgaggactgtcggaaaacccctggcatgggggcagaggtgtcacagtccaagcagcctcactcctgagaagccgccagtgtcccctgattgcagagtgggcagcgcctggagctgtggaggagggtgtctgggggcgggctggcccgctgagcagcgcctctcttcacaggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacctg

SEQ ID NO: 157476 - DNA, 825 bp, Homo sapiens
  Payload ID: 10864
  Gene Symbol: NDUFA13
  Gene Name: NADH dehydrogenase (ubiquinone) 1 alpha subcomplex, 13
  ENST ID: ENST00000503283
  CDS Start-End: 12-374
atactgcgagtatggcggcgtcaaaggtgaagcaggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgactggaaggattacaggcgtgagccaccataccttgtgcagccctgccaattgtaggcatggcgagggtatttgtctgcggaggggctcctcgctccctgagagggaagctcagagacacggggatatctgcagggaaagtaagtcgggggaagcaaccaagattggccaggtgcctctgctgtgggctcctggcacgaaagggtgaagtccgtctgagtccaccgaccaatggtgacgcgcagcgccttcgcggcgcttcctgattggcgggcatgcagggtgggcgggagggaggagaagagggggcgtcccctccctccacggatgcgcttaaaaggcggtggcggtggcggcagcgcccggcgcccgggctcacctcggccatgagcagcgcagccggcccagacccgtcggaggcgcccgaagagcggcatttcctcaggtcagctggggagagggaagctggagacgggcatggttcccatggggccaggagcagcccgta

SEQ ID NO: 157477 - DNA, 502 bp, Homo sapiens
  Payload ID: 10864
  Gene Symbol: NDUFA13
  Gene Name: NADH dehydrogenase (ubiquinone) 1 alpha subcomplex, 13
  ENST ID: ENST00000606722
  CDS Start-End: 1-227
aggacatgcctccgccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggtagcaccgcaggggccaaggaccttgcagatgcttcgggagaacctggaggaggaggccatcatcatgaaggacgtgcccgactggaaggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcagacc

SEQ ID NO: 157478 - DNA, 804 bp, Homo sapiens
  Payload ID: 10865
  Gene Symbol: NDUFA2
  Gene Name: NADH dehydrogenase (ubiquinone) 1 alpha subcomplex, 2, 8kDa
  Uniprot ID: O43678
  ENST ID: ENST00000252102
  CDS Start-End: 203-502
gcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaagctaccagctgctgaagcaaacatgaagggtggcgggggggcagggattctagggccccagagtaagtagaccacactgagt

SEQ ID NO: 157479 - DNA, 627 bp, Homo sapiens
  Payload ID: 10865
  Gene Symbol: NDUFA2
  Gene Name: NADH dehydrogenase (ubiquinone) 1 alpha subcomplex, 2, 8kDa
  Uniprot ID: O43678
  ENST ID: ENST00000512088
  CDS Start-End: 63-293
gttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcctccagggtgcagaatagttaaagacacctccctctctctcttcagcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaa

SEQ ID NO: 157480 - DNA, 435 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000391762
  CDS Start-End: 28-246
gccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtagaggcggggtttcaccgtgttagccaggattgtctcgatctcctgaccttgtgatccactcacctcggcctcccaaagtgctgggattacagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaa

SEQ ID NO: 157481 - DNA, 338 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000391763
  CDS Start-End: 11-196
ggagacaaagatggctgcgagtaagtgcaggagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccc

SEQ ID NO: 157482 - DNA, 267 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000391764
  CDS Start-End: 11-256
ggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagcggctggggaaaagggccacaggatagagctcagctcccactccactcaacgccaaagctgtcctggagccagacggtcctgagctctggcact

SEQ ID NO: 157483 - DNA, 339 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000420296
  CDS Start-End: 1-103
caagtactccgtcatgatcaacaaggccacgccctacaactacccagtagaggcggggtttcaccgtgttagccaggattgtctcgatctcctgaccttgtgatccactcacctcggcctcccaaagtgctgggattacagggccctggagacgtgctggtctcagtggcccacctcctgccccacagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaa

SEQ ID NO: 157484 - DNA, 654 bp, Homo sapiens
  Payload ID: 10866
  Gene Symbol: NDUFA3
  Gene Name: NADH dehydrogenase (ubiquinone) 1 alpha subcomplex, 3, 9kDa
  Uniprot ID: O95167
  ENST ID: ENST00000419113
  CDS Start-End: 59-313
gaccacaactcccagggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccccgaacgtgagcatcggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtc

SEQ ID NO: 157485 - DNA, 694 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000422029
  CDS Start-End: 1-209
gagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtagaggcggggtttcaccgtgttagccaggattgtctcgatctcctgaccttgtgatccactcacctcggcctcccaaagtgctgggattacagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccccgaaccggctggggaaaagggccacaggatagagctcagctcccactccactcaacgccaaagctgtcctggagccagacggtcctgagctctggcactggaggcctgggagccatgcccttgaccagccttgagacctcgagcaagacaaggcaaccattctgaggctgagtttcctgctctgcaaacgacatgacaccctcggctggatgttgcagcggtgacactgaagtagtgacaccagacgatttctgtacttaatgtgatgtcagcacttagtaaacattcatat

SEQ ID NO: 157486 - DNA, 445 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000451517
  CDS Start-End: 25-222
gctgtcgccgccgcggagacaaagatggctgcgagagtcggcgccttcctcaagaatgcctgggacaaggagccagtgctggtcgtgtccttcgtcgtcgggggcctcgaacagtcccatgacactacccccaggatgctccatgatgaccctacactcaaacgtgctcattccatgaccaaccccactgctgcctcctccaggccccacgtatctctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaa

SEQ ID NO: 157487 - DNA, 666 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000417903
  CDS Start-End: 152-349
cacaactcccagagtgctccgcgtccttgctttcgcctctacttgtgctccagggcgcacgcgcagccctgggagcgggttctcgcgcatagggaccacaactcccagggtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgaacagtcccatgacactacccccaggatgctccatgatgaccctacactcaaacgtgctcattccatgaccaaccccactgctgcctcctccaggccccacgtatctctgtaattctgcccccattgagcccctacttcaagtactccgtcatgatcaacaaggccacgccctacaactacccagtagaggcggggtttcaccgtgttagccaggattgtctcgatctcctgaccttgtgatccactcacctcggcctcccaaagtgctgggattacagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaa

SEQ ID NO: 157488 - DNA, 963 bp, Homo sapiens
  Payload ID: 10866
  Gene Symbol: NDUFA3
  Gene Name: NADH dehydrogenase (ubiquinone) 1 alpha subcomplex, 3, 9kDa
  Uniprot ID: O95167
  ENST ID: ENST00000485876
  CDS Start-End: 43-297
gtgctccgcgtcctcgccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccccgaacgtgagcatgtgtgtgatcagaggtgggaacaagtagacggtggccggggtgagtgtggggtcagtttattgggcatgcgtcagtcagaggctgggctggccagggtcgggtagggcagcagtttgtctggaccccgagaaacccaactggaatccagggcctcatctgcttcaaagccaaagtcttcctcaaccttaatctgcaggagataaggaacaaggtgttaacaggcctgggaatctagaaaatcccatcagcttcaccatttttgttttcattttgttttgctttttaaagagacagggtctcactctgttgcccaggctggagtgcagtggtgccatcatagttcactgcagcctctgcctcccaggctcaagtgatcctcccacctcagcttcccaagtagctgggactacaggcacttgccaaccaagcctaacatgttttttctttttggtagagatggggtctcagtatgttgctcaggcaggtctcagactcctggcctcaagtgatcctcccacctaggcctcccaaagtgccgggattacaggcatgagccactgcacctggccagcctcacagttcttgtctg

SEQ ID NO: 157489 - DNA, 379 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000303553
  CDS Start-End: 195-320
gcgagtaagtgcaggtgccggtggcgcacggggctcgggtagttctgggaacctctgggcggtcctgggactgaggagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaa

SEQ ID NO: 157490 - DNA, 646 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000471292
  CDS Start-End: 25-246
gctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccaggtgagtgggggccaggcagggatccccggaataggcccagcctccctgtgctggcgtaagggcagttatgggcaggtctttcctaagcagttatcagagattctgcagtggtgcccggaccccccgttccattttttaagaattgagatataattcgtatactattctgtgtttgtgcttcgtttttgttttttggggtttttttgagacagagtctcgctctgtcgccaaggctggagtgcagtggcgcgatctcagctcactgcaagctcagcctcccgagtagctgggactacaggtgcccgccaccacgacacgcaaactttttcgtatttttttagtagaggcggggtttcaccgtgttagccaggattgtctcgatctcctgaccttgtgatccactcacctcggcctcccaaagtgctgggattacaggtgtgagccaccgcgcctggcctg

SEQ ID NO: 157491 - DNA, 435 bp, Homo sapiens; identical to SEQ ID NO: 157480
  Payload ID: 10866
  Gene Symbol: NDUFA3
  Gene Name: NADH dehydrogenase (ubiquinone) 1 alpha subcomplex, 3, 9kDa
  ENST ID: ENST00000610975
  CDS Start-End: 28-246

SEQ ID NO: 157492 - DNA, 654 bp, Homo sapiens; identical to SEQ ID NO: 157484
  Payload ID: 10866
  Gene Symbol: NDUFA3
  Gene Name: NADH dehydrogenase (ubiquinone) 1 alpha subcomplex, 3, 9kDa
  Uniprot ID: O95167
  ENST ID: ENST00000620289
  CDS Start-End: 59-313

SEQ ID NO: 157493 - DNA, 339 bp, Homo sapiens; identical to SEQ ID NO: 157483
  Payload ID: 10866
  Gene Symbol: NDUFA3
  Gene Name: NADH dehydrogenase (ubiquinone) 1 alpha subcomplex, 3, 9kDa
  ENST ID: ENST00000620109
  CDS Start-End: 1-103

SEQ ID NO: 157494 - DNA, 646 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000622065
  CDS Start-End: 25-246
gctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccaggtgagtgggggccaggcagggatccccggaataggcccagcctccctgtgctggcgtaagggcagttatgggcaggtctttcctaagcagttatcagagattctgcagtggtgcccggaccccccgttccattttttaagaattgagatataattcgtatactattctgtgtttgtgcttcgtttttgtttttttgggtttttttgagacagagtctcgctctgtcgccaaggctggagtgcagtggcgcgatctcagctcactgcaagctcagcctcccgagtagctgggactacaggtgcccgccaccacgacacgcaaactttttcgtatttttttagtagaggcggggtttcaccgtgttagccaggattgtctcgatctcctgaccttgtgatccactcacctcggcctcccaaagtgctgggattacaggtgtgagccaccgcgcctggcctg

SEQ ID NO: 157495 - DNA, 267 bp, Homo sapiens; identical to SEQ ID NO: 157482
  Payload ID: 10866
  Gene Symbol: NDUFA3
  Gene Name: NADH dehydrogenase (ubiquinone) 1 alpha subcomplex, 3, 9kDa
  ENST ID: ENST00000619763
  CDS Start-End: 11-256

SEQ ID NO: 157496 - DNA, 694 bp, Homo sapiens; identical to SEQ ID NO: 157485
  Payload ID: 10866
  Gene Symbol: NDUFA3
  Gene Name: NADH dehydrogenase (ubiquinone) 1 alpha subcomplex, 3, 9kDa
  ENST ID: ENST00000615238
  CDS Start-End: 1-209

SEQ ID NO: 157497 - DNA, 666 bp, Homo sapiens; identical to SEQ ID NO: 157487
  Payload ID: 10866
  Gene Symbol: NDUFA3
  Gene Name: NADH dehydrogenase (ubiquinone) 1 alpha subcomplex, 3, 9kDa
  ENST ID: ENST00000610357
  CDS Start-End: 152-349

SEQ ID NO: 157498 - DNA, 445 bp, Homo sapiens; identical to SEQ ID NO: 157486
  Payload ID: 10866
  Gene Symbol: NDUFA3
  Gene Name: NADH dehydrogenase (ubiquinone) 1 alpha subcomplex, 3, 9kDa
  ENST ID: ENST00000615590
  CDS Start-End: 25-222

SEQ ID NO: 157499 - DNA, 379 bp, Homo sapiens
  Payload ID: 10866
  Gene Symbol: NDUFA3
  Gene Name: NADH dehydrogenase (ubiquinone) 1 alpha subcomplex, 3, 9kDa
  ENST ID: ENST00000611200
  CDS Start-End: 195-320
gcgagtaagtgcaggttccggtggcgcacggggctcgggtagttctgggaacctctgggcggtcctgggactgaggagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaa

SEQ ID NO: 157500 - DNA, 963 bp, Homo sapiens; identical to SEQ ID NO: 157488
  Payload ID: 10866
  Gene Symbol: NDUFA3
  Gene Name: NADH dehydrogenase (ubiquinone) 1 alpha subcomplex, 3, 9kDa
  Uniprot ID: O95167
  ENST ID: ENST00000622523
  CDS Start-End: 43-297

SEQ ID NO: 157501 - DNA, 338 bp, Homo sapiens; identical to SEQ ID NO: 157481
  Payload ID: 10866
  Gene Symbol: NDUFA3
  Gene Name: NADH dehydrogenase (ubiquinone) 1 alpha subcomplex, 3, 9kDa
  ENST ID: ENST00000618420
  CDS Start-End: 11-196

SEQ ID NO: 157502 - DNA, 353 bp, Homo sapiens
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENST ID: ENST00000613276
  CDS Start-End: 28-282
gccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaacccccgaacgtg

SEQ ID NO: 157503 - DNA, 353 bp, Homo sapiens; identical to SEQ ID NO: 157502
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENST ID: ENST00000610406
  CDS Start-End: 28-282

SEQ ID NO: 157504 - DNA, 353 bp, Homo sapiens; identical to SEQ ID NO: 157502
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENST ID: ENST00000612327
  CDS Start-End: 28-282

SEQ ID NO: 157505 - DNA, 353 bp, Homo sapiens; identical to SEQ ID NO: 157502
  Payload ID: 10867
  Gene Symbol:
  Gene Name: NADH dehydrogenase (ubiquinone) 1 alpha subcomplex, 3, 9kDa [Source:EntrezGene
  Acc:4696]
  Uniprot ID: O95167
  ENST ID: ENST00000618338
  CDS Start-End: 28-282

SEQ ID NO: 157506 - DNA, 353 bp, Homo sapiens; identical to SEQ ID NO: 157502
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENST ID: ENST00000617282
  CDS Start-End: 28-282

SEQ ID NO: 157507 - DNA, 353 bp, Homo sapiens; identical to SEQ ID NO: 157502
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENST ID: ENST00000621307
  CDS Start-End: 28-282

SEQ ID NO: 157508 - DNA, 353 bp, Homo sapiens; identical to SEQ ID NO: 157502
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENST ID: ENST00000619253
  CDS Start-End: 28-282

SEQ ID NO: 157509 - DNA, 353 bp, Homo sapiens; identical to SEQ ID NO: 157502
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENST ID: ENST00000619966
  CDS Start-End: 28-282

SEQ ID NO: 157510 - DNA, 1186 bp, Homo sapiens
  Payload ID: 10868
  Gene Symbol: NDUFA4L2
  Gene Name: NADH dehydrogenase (ubiquinone) 1 alpha subcomplex, 4-like 2
  Uniprot ID: Q9NRX3
  ENST ID: ENST00000393825
  CDS Start-End: 265-528
gtctccgcctgcaggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattg

SEQ ID NO: 157511 - DNA, 1177 bp, Homo sapiens
  Payload ID: 10868
  Gene Symbol: NDUFA4L2
  Gene Name: NADH dehydrogenase (ubiquinone) 1 alpha subcomplex, 4-like 2
  Uniprot ID: Q9NRX3
  ENST ID: ENST00000554503
  CDS Start-End: 254-517
caggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaa

SEQ ID NO: 157512 - DNA, 883 bp, Homo sapiens
  Payload ID: 10868
  Gene Symbol: NDUFA4L2
  Gene Name: NADH dehydrogenase (ubiquinone) 1 alpha subcomplex, 4-like 2
  ENST ID: ENST00000556732
  CDS Start-End: 8-289
caacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaaggtacctctcgatggctctagggttgccccccatcctcttatctcctggtcctggcacccacaactcccgtactagaagcaaagggaggcttggggtactcagcgcaaccccctttccctctcctcttagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctc

SEQ ID NO: 157513 - DNA, 1901 bp, Homo sapiens
  Payload ID: 10869
  Gene Symbol: NDUFA5
  Gene Name: NADH dehydrogenase (ubiquinone) 1 alpha subcomplex, 5
  Uniprot ID: Q16718
  ENST ID: ENST00000355749
  CDS Start-End: 461-811
gtgcgaagaactaacttgctgttgagagatcaattcagaggatgctcaagctccgttatcactttcattttactaaactgagaaaggaaggttgaggaatgcatcaacggttaagcacagtgcaggttcctacagcgactggagttttttggtagttgggagtgtttccctcaatctttgggcaagccgtcagcagtggcaggaacaggaacagacagctgggaaaccctttctttccccaatcgtcttctagcttagctttaggcttgtatgcccatcgcgcatgcgtcaatttttctcttttaagatgggcggggcagagtctttgctcctttggcgatcctgaaggggtggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttccta

SEQ ID NO: 157514 - DNA, 1360 bp, Homo sapiens
  Payload ID: 10869
  Gene Symbol: NDUFA5
  Gene Name: NADH dehydrogenase (ubiquinone) 1 alpha subcomplex, 5
  ENST ID: ENST00000378795
  CDS Start-End: 1-337
tgaacagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgt

SEQ ID NO: 157515 - DNA, 5608 bp, Homo sapiens
  Payload ID: 10869
  Gene Symbol: NDUFA5
  Gene Name: NADH dehydrogenase (ubiquinone) 1 alpha subcomplex, 5
  Uniprot ID: Q16718
  ENST ID: ENST00000471770
  CDS Start-End: 136-486
aagaaggtgagacgaatggaggtcactgttggaatttagactgtgggggtagactcagtccgatagccctacttcccgcgggtgttgacccctactgtcgcgggctcggcggtgcttttcggggactcgttctgcatgccttaccgggtagggcagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttcctagctccctgtcattcctaaatacttggttaaatttaacgtggtatctctttccttcatagatagtactatactcttgtggggttttgtgtatacgtgtgtgtgtgtgtgtgtgtgtgtgtgtgtgtgtgtgtgtgtgtgcacgcgcatgcgcacatttgctcagaatgagaaaaaaatggtatttttccttctttccagtatatttctcccctcatagagctgtaacatgaatactaaataaatattaaataaggtggattcttagaggttagagtgcaagaaggctccttctggtggggaagtgttagagggggagttagaagcccagggtttctcattctcatggttctagtgttgttaactcaatgactacattgaggcaagtttggcctgtttctcagaatggcctatttctaatgctgcaaaagaaatagaatatgatttataacaacattttcagttctaaacatttcttgaatatataatatatttattaaaacatgatgctgaagtgtgtttgcatgggtactttcaaggtaattttctagccaaccattatttttcaggtcctttggacaacacagaaacaaagatggcttgctgtgtttttgtcatattttcagtcccgtatctgccatgattcttgggcatcttttatgtttcaccaacagtgttactgaacttttttgctaaaaggggaccttactggtgtttgcattagaaatgctagttgcagaataatagtcattgtaaaaataatattataacaataatagctaatgtttgttgagactttaatatgaatgtcaggcactatcataagtacctgactaatttcactcattaaacctgcactacaaccctaagagtgatactacaaattatcttcattttccagataagaaaccagaaccctacgtgagtagttttcccctgcaattatgcaacttggggccttggggacactgaaaccaagagatgatttaataacaaatccaaggtcacatagctagtaagatgtgaagctgaagtttgaacccaggcagtctggttctagaactgatgctcctgttatattattatttatgaatatgcttgggatgttgtgacttcttcctgtgctgtatgggctgtaccaaatgaaactagatcctgctctctttaccttttctgtcaaaattatctgtaaagaacaaatatgagcagaagtagtaaacgatttcattttctgcaaagagctgcatataggttataggcagattatgttaatgggataggtatctaaaaggtattgcaatttggtcattggttctttctcctgtctcaattgctcacagaactttacacctgatcgtttttactccttcagtcttttcccagttgcttcctataaacatccaggttaagtctcctgatcactttgcaaatgattcttttattcagagatcttcagtgttttgagtggctactaaactaattttaataattttcagaatggcctatttcagttctcccatgggtttcattctagttaatcatcatactgcagatacttcaaaagaaagagaagctaatcaatttgagctttgctaagaaagaagaaatggcaacaaagttgatgccccctttctcccacactgggacttagtgcagacgattccaatttcttggcattctttcctttgggatgaaaatggcttatatttaggataactataggataatttatcattccacttggaatgattttgagtgaaaataattacataaggataacagatgtacaccatgactgtcctgggcaaacaagatataggggggcaccctactggagtaaggctcaggtctcaaggttgccatctttcccacaccagtaggatcaactagtctgtcattggaatagaatgaattgatgccagcagtagtagtcatcatgtgcaatcaggcctcaagttttattgtatcctttcactctccctcattctcccctccccctccttttccctcagaattgggggatggaagaaaagagagcttatattttattgtcaattttctaatcacattcagaggagcgaagctaattaagccaataacaatgtttatgaatgtatcttttttaaaagggagatgacaatatataggaaaattcccacatgtaggctaatagcagctttttctttttcctcccatcctctatgattatgtaaacatacagaagtctaacaccctacacaagtgtattgtggggtatgggattaagtaccaaattgctgaacatatcactagtattttggatttgctgagtgcagtcttcccattaaaactaagtgttcagtagggaggcgtggtggctcacacctataatcccactactttgggaggccgaggtgggtggatcacttgaggtcaaaagttcgaggccagcctggccaatatggtgaaaccccgtctctactaaaaacaaaaacaaaaactaagtgttcagtgagattgtagcctatgctacaacaatagtaatgccaattgttttagagaaaagtaaatgagaggctaccagttgtgtttagaggaggtcgacgttttattttagacaaaattcacaggaaatcacagtgggaatgtgataaggggtttgaatgattgatggggacaggaagaattcatttgagagactagagatgagtcagtattctagatcgtgaagtaaaatagtgagtcatgtagtgacttagcatgggttatccttaaatcccagtgtcttaagtgtattttttattcatactgcatgtctaaggagggttggcaaggagtgctcatagacccacaaggaatccaggctgagtgtggcaccatcaacatatatttccatgaccatagtggtggtggggaattggaacatggtaaattacacataggaataaaaaaaaagaaacaaccaaggttaaatttttttttgactgtgccacaaaatttatgaattgaacttgccatgcatcactaataattttcaaattggtctttaggtttacattagcagctaattttttgtggtacacttaaatgtaatttatgattggcatctgtatataattaaatgaaaagcattgcaaagatttctattttggtatttctcatgatcttcaatttttttttaggtgaatctattaggttttctaaagataactatttttttttttttacaaaatattggcattttaatctctctataactggagggtgaattatttttcaccagagtaaaacaggtccaaagtcccttatctaaattcctaatttcaaaaatctctgaaaacaaagttttttcataactcatttggcaacaaaccccacctgaattacatgaggctatttgtggtatttatcgcacttcaatgtgaatatgaatatattttgccacagatgtatcaatatatttgattctaaactgcttcctcagaccctcttaatgtgttacataatgtaaagtatatgcccatatttcctttcaaaaatctgaaaaattgtgaatatcaaacacatctgtcttaaaaggtttcagaaaagggacaatagacctatatttccattctcttaacaagttcacaaagtggtattatgatccaaatttaatctaaataatttccaaaacaaaaattttcaggtccttagttttctaaattattttaatattaaaaatattcattattcattttaacctgtagtaacaacaggagatactttgaaatgcttgattttatcaagccactaggtggcatctttgtaaaaataaaagcacatcaaaagaaatgtttattacataaataaatgctgagatgaataaaggtagatgtttcatgagaaatacgaagtcgtttggtggaataaatcctgagaaaatgcatagatttatcatgaaaaggaaaatggaaaatggtattgtaaaattactctttcacttttggaattgagaagctttttcctattggttgttttcattaagtttgaatataaatttattatgtaaccaaa

SEQ ID NO: 157516 - DNA, 778 bp, Homo sapiens
  Payload ID: 10869
  Gene Symbol: NDUFA5
  Gene Name: NADH dehydrogenase (ubiquinone) 1 alpha subcomplex, 5
  ENST ID: ENST00000466896
  CDS Start-End: 7-219
gctgtcatggcgggtgtgctgaagaagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcgcctatcataatgcaaattatcagtagttaatcaataagaaggtgttatttgagcaaagatttgaaaagtggtgaagaaacaagtgatgcagataccctgggccatccagcaagataccctgaggcagtaacatatcacgtcttgtgttgaaaagcaaaatgaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaa

SEQ ID NO: 157517 - DNA, 459 bp, Homo sapiens
  Payload ID: 10869
  Gene Symbol: NDUFA5
  Gene Name: NADH dehydrogenase (ubiquinone) 1 alpha subcomplex, 5
  ENST ID: ENST00000470123
  CDS Start-End: 181-459
gggctcggcggtgcttttcggggactcgttctgcatgccttaccgggtagggcaggttagtggttccgctccgagagtcaggaaaaaagctccaaacaagcgagactgagagaccagtagctggctttagaccagttttagccgggggattcgtggttttgtatttccttagcgtgctggatgtatggaaaccgtagtaaacagcatgaatcgtgttttgtttttgaacagaccactggccttgtgggattggctgtgtgcaatactcctcacgagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcag

SEQ ID NO: 157518 - DNA, 1432 bp, Homo sapiens
  Payload ID: 10869
  Gene Symbol: NDUFA5
  Gene Name: NADH dehydrogenase (ubiquinone) 1 alpha subcomplex, 5
  ENST ID: ENST00000618945
  CDS Start-End: 110-343
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaccactggccttgtgggattggctgtgtgcaatactcctcacgaggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttcct

SEQ ID NO: 157519 - DNA, 1504 bp, Homo sapiens
  Payload ID: 10869
  Gene Symbol: NDUFA5
  Gene Name: NADH dehydrogenase (ubiquinone) 1 alpha subcomplex, 5
  ENST ID: ENST00000611607
  CDS Start-End: 110-415
tggagctaagctgtttccagggtgacagagtggcgacctcggtggtcgattgagcaggtctgagaattgttcccaaagggttgtgcgtcaccgagtcgttggcgctgtcatggcgggtgtgctgaagaagaggctaagaatattgtacacaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttatattaagagcgtgttcttattactgacattttgtaatcaagaaaagtgatatagaaaatatgtaggagactgttaaaattggtgattatggtaatatggtcatgtgaatcaatttttgatttataaagtactcacacaagttgtttcaaagatgatatttctgtgaacagagaggccatgggaagatttgaaaattattaaagaaaaattcctacagattttcaatgcagagaccataatcaaaaagtaaactttctttagtagtatgttcaatacatcatttaattttttaagttatcctgaagaaggaaaggtccttaattattatagtctaaacaaatttatagattactgtttgaagtaaataatacgagtgaatattttcaaatgtgataaaatagcacaagtggctggtgataaaatttgaaattatggttaacctcagctgtgatcttatgtatgtaaagtgaaatttaaatagataattataggttgattacaaaatccatagtgtcattttattttagtcattattgaattataccatttactctgttttcttatagtcttaattttattatattttgttgttactgtattatatttgaaaaccttcaaattagaatacattgtacagttaaagaaattgacttggtacttaaaagaaagatttcccattgcatacaggttattggagaaattttccttttgttgcatttgtggaagttagttttctggcccgtggcctttaattttcttaatcaacctaattacatcaggatagaggtagagtttctgtaaaagaagagacattaagagttcctgaaatttatatctggcatacggataggcttatattcaaaacatcttagtcatacgaccataaattaaaagtggagtcactaaatagtttgcagtacgtttctaatataagtgtaggtgggtatcaaaacaagacaaatgctgttcagggaaagaagttggcaagcttaaggttaaacaaaaataaaattacatgtgttttcgccttcct

SEQ ID NO: 157520 - DNA, 1256 bp, Homo sapiens
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENST ID: ENST00000498737
  CDS Start-End: 134-598
ggcgtttctgtagatgagcatgcgcagcacccaccgttcgctcagccagagagaggcttcccagccaatccgagagcctcagagtcatcctcccgcccacccagcatacaggcggggcgttcctccttagccaatgggaaaagacattcgcccgcggtccgcacgcgctgcttgcaaaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactgat

SEQ ID NO: 157521 - DNA, 1080 bp, Homo sapiens
  Payload ID: 10870
  Gene Symbol: NDUFA6
  Gene Name: NADH dehydrogenase (ubiquinone) 1 alpha subcomplex, 6, 14kDa
  ENST ID: ENST00000602404
  CDS Start-End: 36-422
aaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactgat

SEQ ID NO: 157522 - DNA, 475 bp, Homo sapiens
  Payload ID: 10870
  Gene Symbol: NDUFA6
  Gene Name: NADH dehydrogenase (ubiquinone) 1 alpha subcomplex, 6, 14kDa
  ENST ID: ENST00000470753
  CDS Start-End: 193-408
atgaatcacatgtctcatcctcaagcacctagcctagggtcaggctaattttttggtgaagaaatgaatgggcgacctgtatgtgttcaatgagtatcatttgactctaggttttatttaaccatacaatttctaccctgagtcatgtttttctctctagtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggt

SEQ ID NO: 157523 - DNA, 1256 bp, Homo sapiens; identical to SEQ ID NO: 157520
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENST ID: ENST00000605916
  CDS Start-End: 134-598

SEQ ID NO: 157524 - DNA, 1256 bp, Homo sapiens; identical to SEQ ID NO: 157520
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENST ID: ENST00000605927
  CDS Start-End: 134-598

SEQ ID NO: 157525 - DNA, 1183 bp, Homo sapiens
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENST ID: ENST00000617763
  CDS Start-End: 63-527
gagagcctcagagtcatcctcccgcccacccagcatacaggcggggcgttcctccttagccaatgggaaaagacattcgcccgcggtccgcacgcgctgcttgcaaaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacacttcagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactg

SEQ ID NO: 157526 - DNA, 1256 bp, Homo sapiens; identical to SEQ ID NO: 157520
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENST ID: ENST00000610887
  CDS Start-End: 134-598

SEQ ID NO: 157527 - DNA, 475 bp, Homo sapiens; identical to SEQ ID NO: 157522
  Payload ID: 10870
  Gene Symbol: NDUFA6
  Gene Name: NADH dehydrogenase (ubiquinone) 1 alpha subcomplex, 6, 14kDa
  ENST ID: ENST00000607132
  CDS Start-End: 193-408

SEQ ID NO: 157528 - DNA, 1183 bp, Homo sapiens
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENST ID: ENST00000627617
  CDS Start-End: 63-527
gagagcctcagagtcatcctcccgcccacccagcatacaggcggggcgttcctccttagccaatgggaaaagacattcgcccgcggtccgcacgcgctgcttgcaaaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacactttagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactg

SEQ ID NO: 157529 - DNA, 475 bp, Homo sapiens; identical to SEQ ID NO: 157522
  Payload ID: 10870
  Gene Symbol: NDUFA6
  Gene Name: NADH dehydrogenase (ubiquinone) 1 alpha subcomplex, 6, 14kDa
  ENST ID: ENST00000628198
  CDS Start-End: 193-408

SEQ ID NO: 157530 - DNA, 475 bp, Homo sapiens; identical to SEQ ID NO: 157522
  Payload ID: 10870
  Gene Symbol: NDUFA6
  Gene Name: NADH dehydrogenase (ubiquinone) 1 alpha subcomplex, 6, 14kDa
  ENST ID: ENST00000630511
  CDS Start-End: 193-408

SEQ ID NO: 157531 - DNA, 475 bp, Homo sapiens; identical to SEQ ID NO: 157522
  Payload ID: 10870
  Gene Symbol: NDUFA6
  Gene Name: NADH dehydrogenase (ubiquinone) 1 alpha subcomplex, 6, 14kDa
  ENST ID: ENST00000628004
  CDS Start-End: 193-408

SEQ ID NO: 157532 - DNA, 1080 bp, Homo sapiens
  Payload ID: 10870
  Gene Symbol: NDUFA6
  Gene Name: NADH dehydrogenase (ubiquinone) 1 alpha subcomplex, 6, 14kDa
  ENST ID: ENST00000625834
  CDS Start-End: 36-422
aaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacactttagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactgat

SEQ ID NO: 157533 - DNA, 1080 bp, Homo sapiens; identical to SEQ ID NO: 157521
  Payload ID: 10870
  Gene Symbol: NDUFA6
  Gene Name: NADH dehydrogenase (ubiquinone) 1 alpha subcomplex, 6, 14kDa
  ENST ID: ENST00000628740
  CDS Start-End: 36-422

SEQ ID NO: 157534 - DNA, 1256 bp, Homo sapiens
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENST ID: ENST00000630201
  CDS Start-End: 134-598
ggcgtttctgtagatgagcatgcgcagcacccaccgttcgctcagccagagagaggcttcccagccaatccgagagcctcagagtcatcctcccgcccacccagcatacaggcggggcgttcctccttagccaatgggaaaagacattcgcccgcggtccgcacgcgctgcttgcaaaggggtggggttgtggagtggatgctttggcaagatggcggggagcggcgtccgccaagctacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatggtcactttgtgatagaattccattgatgaaccaattttctgcagcctctttttgcctgagcaagtgggaccttggtatacacatcacctgttctttcccttttcttgaaatgtggtgtttgctgtaaattggattgaattatttttctcagagccttgcatgtcagtaaacaggaaggaaggaggccatctgttcaaaaattgtgacattgggcatgaggctggacgacttgttaatgtagttgtttctatagcccctatgattagacactttagtgtcagggcacagattatctaaaattagccagctcttcctgtcagggatcagggcagcactaacaggcgcaaaagtagagctgtcaagatgggctagttttccttgggttctgaagaaaatggatgtgcaaaggcttggctccgctacttgtaacaagctccagcccttaaaatgaaattaacttcctactcaggcaccctgcttaggtgcacagctgttcaatatacacagagaacagaaatattcctactgtctttggaaaccctggtgtacctctcagtggcagaataaacatcaacacaggttcaagaactgat

SEQ ID NO: 157535 - DNA, 1080 bp, Homo sapiens; identical to SEQ ID NO: 157521
  Payload ID: 10870
  Gene Symbol: NDUFA6
  Gene Name: NADH dehydrogenase (ubiquinone) 1 alpha subcomplex, 6, 14kDa
  ENST ID: ENST00000630971
  CDS Start-End: 36-422

SEQ ID NO: 157536 - DNA, 601 bp, Homo sapiens
  Payload ID: 10871
  Gene Symbol: NDUFA7
  Gene Name: NADH dehydrogenase (ubiquinone) 1 alpha subcomplex, 7, 14.5kDa
  Uniprot ID: O95182
  ENST ID: ENST00000301457
  CDS Start-End: 39-380
acgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaccatgtttcccaggctgatcttgaactcctggcctcaagcgatcctcctgccttgacctcccaaagtgctgggatt

SEQ ID NO: 157537 - DNA, 569 bp, Homo sapiens
  Payload ID: 10871
  Gene Symbol: NDUFA7
  Gene Name: NADH dehydrogenase (ubiquinone) 1 alpha subcomplex, 7, 14.5kDa
  Uniprot ID: O95182
  ENST ID: ENST00000593729
  CDS Start-End: 18-359
agtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcagcaacccgactccgagaatggacgtttcatttattcatttactcaccaaatgtttactaagagcctactatgagtcaagcactatgtgtcagatcctgagaataaagcagtgagcaac

SEQ ID NO: 157538 - DNA, 414 bp, Homo sapiens
  Payload ID: 10871
  Gene Symbol: NDUFA7
  Gene Name: NADH dehydrogenase (ubiquinone) 1 alpha subcomplex, 7, 14.5kDa
  ENST ID: ENST00000601101
  CDS Start-End: 18-209
agtatcgcggacggaagatggcgtccgccacccgtctcatccagcggctgcggaactgggcgtccgggcatgacctgcaggggaagctgcagctacgctaccaggagatctccaagcgctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcagcaacccgactccgagaatggacgtttcatttattcatttactcaccaaatgtttactaagagcctactatgagtcaagcactatgtgtcagatcctgagaataaagcagtga

SEQ ID NO: 157539 - DNA, 553 bp, Homo sapiens
  Payload ID: 10871
  Gene Symbol: NDUFA7
  Gene Name: NADH dehydrogenase (ubiquinone) 1 alpha subcomplex, 7, 14.5kDa
  ENST ID: ENST00000595856
  CDS Start-End: 18-248
agtatcgcggacggaagatggcgtccgccacccgtctcatccagcggctgcggaactgggcgtccgggcatgacctgcaggggaagctgcagctacgctaccaggagatctccaagcgtagaaacggggtttcaccatgttggccagtctggtctcgaactcctgacttcataatccgcctgcctcggcctcccaaagtgctgggattacagaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcagcaacccg

SEQ ID NO: 157540 - DNA, 844 bp, Homo sapiens
  Payload ID: 10872
  Gene Symbol: NDUFA8
  Gene Name: NADH dehydrogenase (ubiquinone) 1 alpha subcomplex, 8, 19kDa
  Uniprot ID: P51970
  ENST ID: ENST00000373768
  CDS Start-End: 143-661
ggttgggcagggcaatacgcctgcgtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaatgtgataagcccaacaaggagtttatgctctgccgctgggaagagaaagatccgaggcggtgtttagaggaaggcaaactggtcaacaagtgtgctttggacttctttaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaa

SEQ ID NO: 157541 - DNA, 8363 bp, Homo sapiens
  Payload ID: 10873
  Gene Symbol: NDUFA9
  Gene Name: NADH dehydrogenase (ubiquinone) 1 alpha subcomplex, 9, 39kDa
  Uniprot ID: Q16795
  ENST ID: ENST00000266544
  CDS Start-End: 21-1154
gtgggggattgtgggaaaagatggcggctgccgcacaatcccgggttgtccgggtcctgtcaatgtcacgttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaatcttattggacgagactgggaaaccaaaaactttgattttgaggatgtttttgtgaagattccccaagcaattgctcaactgtccaaggaagctggagttgaaaaattcattcatgtttcacatctgaatgcgaatattaaaagctcttctagatatttgagaaataaggctgttggagagaaagtagtgagagatgcatttccggaagccattatcgtaaagccgtcggacatctttggaagagaggatagattccttaattcttttgcaagtatgcatcggtttggtcctataccccttggttccttgggctggaagacagttaaacaaccagtatatgtcgtagatgtatccaaaggaattgttaatgcagttaaggatcctgatgccaatgggaaatcctttgctttcgttggtcccagtcggtacctccttttccacctggtgaagtacatctttgctgtggctcacagattgttcctcccattccccttgccgctttttgcctatcgatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaattctgcagtattttcttccttgatttacaaaatgagaaatgtagtcacttagaacttgagcatgatttttgttaaacatatttaataatgatatatatactatttattctctgaaatgccagagagtttgaattttcctatgacaaaccacttctagcatacgttctagaagacaaggaccctttttaatgtcaaagtattgtaaagaccccaagtgatatgtgattgttttttaatttccattaaatgagagagcatacagtatcccctaacctgaatgtgtttacactgaaggtgtttttaaaatttattttaataatgtccatatgccttttaaaaatagtagtacatatatagaaaaacattgtccatagattctcaaaccccttgcagtaattccacagtcttcttggatctgagctatctgaggccagcccgatgcccttagtaccacatctggattatttcagacacataggtggagatagattctcttcacatgcaaaggagatgcttcagcttctatgccagcagtgccagcacttaggaattatgaccttctaatgaagttcttaaaattgcagccaagacccagatgaacatttggtttagtgttggcaaatcccaccagtacagtgtgatttaaaactcccacaatttgtggtgaagccaacataccaccatcctaggtgacccagggttggtcattgtgtttcactggacttcagcctcctgatctatatttgggacagggatgtcagtaaaaacgctgtttgatgagggaatgcccgtctccttacagagagaaaggtatatcagtgttgaaggtaagttctccacctgccctttctgcctgcatcagaatctttttatcccaaaacggtcaacagtgagctactccaagtgtggtccatagatcaccagcattgggatcatcttggggcttgttagaaatgcagaacccgggctgggcacagtggctcacacctgtaatcccaacgcttttgagttgctgtggtgggacggtcgcttgaggccaggagtttgagaccagcctaggcaatatggcaagaccttgtctctacagaaaaatttcaaaaagttagtagggcatggtggcacgcacctgtagtctcagttattcgggaggctaaggtatgatgattgcttgagcctgggagttcaaggttacagtgagctatgatagtgccactgcacttcagcttggactgaagatcctgtctcagaaaaaaaaaaaaaaaaaggcagaatcctaggttttgtcctgtcccaggcgtgttgaatcagaatctgcattttagcaaggtctccaggagatttgtatgcacattacagtatgagaagcactgccatacagaagagctgtatcagagttcagtgtgatccctgttattaatccaggttgctgaccccaccccagacctactgaatcagagtctcaggaaggagggcccaggaattttagttttattaaacattctagtttattctcctgtacactagtatgtcagaatcagcgtactagggaaaggaacacaaacccaacttcacgttttttcttcagatgctgtctgttattttggatgacacccctcctggccataagccagccattaggcacagagatgggtggatttaatttgaaaaggaactataattctataatgcacagtgtcctctcttagaatatctacactttctttcctttttttgattcttaaaaaaaaacttattgatacataatagatgtaaatattgtcagggtatatgtggtaatttgatatattcatataatcaatcagtgtaattgggatatccatcaccttaaacatttacctttatgctagtaacattcaaattactctcttctagctattttgaaatgtacagtagattagtattaactctagttaccctactgatctattgaacaccaggtcttacttcttctgtcttaactgtaattatcttcattttctagcaatgctatttctcatctctaacttgtatcatctcaggatgctgtatatttcttttattttttattttttatttttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagtacatcttgcaccgcccttaatccatttaaccctgagtggacacagcacatgtttcagagagcacagggttgggggtaagatcatagatcaacagcatcccaaggcagaagaatttttcttagtacagaacaaagtgaagtctcccatgtctacttctttctacacagacacagcaacaatgtgatttctctatcttttccccacatttcccccttttctattccgcaaaaccaccatcgtcatcatggcccgttctcaatgagctgttgggtacacctcccagacgtggtggtggccgggcagaggggctcctcacttcccagtaggggcggccgggcagaagcgccccccacctcccggactggtcggctggctgggcggaggcgccccccacacaaacactgaagccgtagcattgactaaggaaacaattttaccatcctaagctagtggatgtcaccctctcagtgtatggaggttgcatatgacaagtaactgggagctgggcataagatctaggacactcatatccagggtgattctcttcataaggaggcatgggctgagtctccatttataggggctgtccccatagagacttcaagccacacctttctagggattcaggttgcacattacctgattctcacagttgatttgagcctgcaagactgtaaacccatcccattatcatgttttcttcctcatttacctacatttatcattaaacctttgtgattcagcaaatctgtttaccttctgattctactttaaattccgttcatgttcttccttggccctcctgtgtatttcccacagctttgctaggccttaagatcatctcacattcttcatcctaatgacaaaaataagttctatgggctgggcgcggtggctcttgcctgtaatcccagcactttgggaggctgatgggggtggatcatgaggttaggagttcaagaccagcctggccaatatggtgaaaccccgtctctactaaaaaatacaaaaaatcagccaggcatggtggggcccacctgtatatagtcccagcccaggagggagactgaggcaggagaatcactgaaacctgggaggcagaggttgcagtgagctgagatcacaccactgcactccagcctgggagacagagggagactctgtctaaaataaataataataataataataataaaggtacatgatggaagcatatatgggaatatatgcaaagatctctgagaagataaagaaaggtctctggaaggattagcaaaaactccatagaaaacggatttttaaagctgcatcttgatgttaacctgctgaaatgtgtgtgttggaccggggtgaggaggaagcagtcattcatgctgtggaagagaacagcatgagcaattgcagtggggcatgaatgagtgggtggttatgagtgggaggcagagtccgtgagttgggaggggcacaagcgagtttaacctttaccttggaggtgatgcagagcagttgagttccatacagatttggcttcgaatatgagttccactacttcttagttgtgagattggacaagtcacttgacctctctttgtcagcctcagttttcttgtttataaaatgggggtgatagtaataactacatgatgggatagtgatgaggaattaaatgagatcatgcatgtaaaatgctgagccctgcacataataagaactaagtaaatgtgagccattatcatttaagtagggaatatcatgcccatctgagtccatacatttgtttcctgacttaataaaatagctgccgttcctgagaaggagggattcctatttcccaaatgctggaaacagggacttatagaaggtaaattgccccattagtaagtagctgaattggttttccaacctggatctttctggctacaaaactgatgccttgttccagaaaggatttaaggatgctcaggaggaagacattcccagagttacactctagaaggtcttggagtgaatgggaggtatagtggaatggagggcgtatttgaagaaacccttcctgtgaaggaaaatccaagagaatgaagtaaggagagacttaaacttgaaaagattcttgtgagagaaggaaaggggctatttacaatagagaagagactagaagaaagtctgaactcacctccctggaagcagagggtggtggggtttttgagggctgtgtgagagtgtagaagtactgagaacaagaagccatgtggatcctgtgagggccaggatgggggggggggtcatgggtcatctgtgtttgctgattggctttatccaaaggaagagtaaacatctcatccttatgacaggaagtagtcctgcagcttggagcaaggtgcccaccaaagttaggcacatcccacagcaagtgggagaaaggagtgctatctccttttgaggttacatttcagagaatggttcccctgggtccttgagaaagacagtcctgggttgtaaaactggcaagaggctgagggaagatgtatgtctcaaaggggaactcaaataatttataattttaagttttctgatgctctaagggaagtcaggtgcctaatattggtgatgtggtttggatgtccccacccaaatctcatgttgcaatgtaatctccagtgttggagttggggcctagtgggaggcgattagatcatggagtagatttatcatgaatgatttagtaccattctcttggtacaatcctcaagatagtgagttcttacaagatctggtcatttaaaagtgtgaggcaactctcctcaccccttgttcctactcctaccatgtgaggtgcttgctcccttttcacctactgccatgactggaagcttcctgaagcctccccagaagcagatgcctatgtgacgcttcctgtacagcctgcagaaccatgagccaattaaacctcttttctttatacattacctagactcagatatttctttatagcaatacaagaatggcctaatcgtgttaggaagaagcctgtctgaagtgcagtcaggctgaggggagcatgaaggccatcttgatgggggaaatcttttagtaccctaatgcgagcagatgatgatgttgttggcagagagggagggtataacttgtggtgcctagccctagagggaatggaagggccagaatccagagcataggtgggattgtgtgggctgacaagtaatagtatatgatagcatagtatatgatagcagtagtatacgatagcatgtgtgtgagtccattttgtattgccataaaggagtacctgaagctgggtaattaataaagaaaaggggtttatttggctcactgttctgtaggctgtacaagcatggcactaacatctgcttggcatgagccaccacacccggccagaattttatttttagtgactaggctttcctttaaaacctctgtactaggccgggtgcagtggctcgcgcctgtaatcccagcactttgggaggctgaggtgggaggatcacttgagcccaggagtttgagaccagcctgggcaacagagtgaaaccccatctctttaaaaaaataaagcacttgaagcagaactttttatctgtcataatcactgctatgtccacagcacctaaaacagtcccagacatctgttgaataaatgaatgaatgaggtgggaagtctttctttacacttagatgaaaactccatcggaccccaaattgttctggtcttgttcaggtaataattttaattctataataaaatctcaagttataataggctcaatttgataattaggatgcccagtgttgtgtaataattaaagcgttaaatttcctctctgccccacagctgggatccaagaagaccctgtggctggctactcttctgtattttcatttatctccacccccagtttaccagcagtggttatcctctctccaagactgggccaggggtgagaagggcagtcttaccaggcaagggtctttgctgacagatgtctgggccttcttgacagcaggtgtttaaagctgaatctggttctactttcaggagagtgatggtttgagatggtaactgaagttgtagaagtagatgttgaggatgaagtatcatattaataaaacattgcccattaacaccttagcacaaattaaaactagctatacctcactgataaggacctgaatggctaaataatgatgaatgatttatggatgtagcggggaactgggtggaagcagtagtaagaaatttgaattaaggaatcgtaagggaatcgagattatctagtttcccctcgacattttataactgaataaacaataaaaaacaagagaagtgacagctttatagcatctgattggggaaaaacacatcttttctggggctagacagtccataaataggacttggaaatggaagtgtagggggagatcccattgtacttcagtggaaaactatgcattgtctggaatctagactctggacaaagacccttccttcctggctgtttgattttgattctatgggagctatcttgcaactctgtaagctgtaggtaactgatagcagagcaaaataattcttgtctatagacgtgtacattgtgtcttagcgtagattcacccgacctccttccccagttttgcttctattagcacatttatttcagtaattttgatctttggattctccttggacattcctcactgaaaaatgaaataaaatttttggcatgtgctcttcttttgca

SEQ ID NO: 157542 - DNA, 642 bp, Homo sapiens
  Payload ID: 10873
  Gene Symbol: NDUFA9
  Gene Name: NADH dehydrogenase (ubiquinone) 1 alpha subcomplex, 9, 39kDa
  ENST ID: ENST00000540688
  CDS Start-End: 107-517
tgtttgttggttttatttcattttaagtttaagatctgttgtttctttggaggagaacaaagtgtaccagcagttacagcagccgactgggttggcttgagaggagatggaccaaaaagcagaggtagcctcacaggtcgaggtggttattttcttaaaaaaaaaaaatcagttcagactgctctacagcggtctgtcttcctgcagttctcataggctagcttacatcttgggcagagagatgcttatcacatgtgctatatgtatttctctttccagatgggtagcaagagtctttgaaataagcccatttgagccctggataacaagggataaagtggagcggatgcacatcacagacatgaaattgcctcacctgcctggcttagaagaccttggtattcaggcaacaccactggaactcaaggccattgaggtgctgcggcgtcatcgcacttaccgctggctgtctgctgaaattgaggatgtgaagccggccaagaccgtcaacatttagtgcctcctgagcagctcttggttttggcgtcttttgggtcggcccatgtggtttgagcacccagccaggcggtctctttagaggatcctgtacacagttccactattaaaacatttcaggttgaa

SEQ ID NO: 157543 - DNA, 512 bp, Homo sapiens
  Payload ID: 10873
  Gene Symbol: NDUFA9
  Gene Name: NADH dehydrogenase (ubiquinone) 1 alpha subcomplex, 9, 39kDa
  ENST ID: ENST00000535050
  CDS Start-End: 64-512
gcattggtacatgaactttgagggttcattctagtaccaagaacctcagtcaatgaaaaagaaatggtggaatgtttgacaagtctcttgctgttaaactttctaaaagtcagaatatcttttctcaagcacttcactccttttatcattatttgtgatgttcttcagtggttttatagttctgccattactgcaatagccacatctgtgtgtcacggcccaccctgtcgccagcttcatcatgccctcatgcctcatgggaaaggtggacgttcctcagtcagtgggattgtggccactgtgtttggagcaacaggattcctggggcgatatgttgtcaaccaccttggacgcatggggtcacaggtaatcataccctatcggtgtgataaatatgacatcatgcaccttcgtcccatgggtgacctgggccagcttctgtttctggaatgggacgcgagagataaagattctatccgacgagtagtacaacacagcaatgtggtcatcaa

SEQ ID NO: 157544 - DNA, 528 bp, Homo sapiens
  Payload ID: 10874
  Gene Symbol: NDUFB1
  Gene Name: NADH dehydrogenase (ubiquinone) 1 beta subcomplex, 1, 7kDa
  Uniprot ID: O75438
  ENST ID: ENST00000329559
  CDS Start-End: 141-458
gtgctgtcggaaggcgacggcggtcacgcctgcacgcctcgtctgtctggagcgaaattttattcagaaattattggtaatgtttggaagctaaaaaaaaaaaaaatgagaggagtcaaccctgaggaggaaaaagtagtatgatttgctggcgtcacccctctgctccgtgcgggcgcggcgaatggcaggtcccgaggtcgcagcttccactggcgcgggttgagttccctgttgcccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaa

SEQ ID NO: 157545 - DNA, 458 bp, Homo sapiens
  Payload ID: 10874
  Gene Symbol: NDUFB1
  Gene Name: NADH dehydrogenase (ubiquinone) 1 beta subcomplex, 1, 7kDa
  Uniprot ID: O75438
  ENST ID: ENST00000555441
  CDS Start-End: 215-391
cgtagagatgtgacccagtgaccgcccgctaaccggactggagagaagaccggcccggatcccacgcctggcctgaagcagggaagacgctgcctcccctccgcgagcagcttacattcgtccaagttccagccttctgtcttctcgctaacctcgctctcttccaaatcgcaaatcctcttgagccgacaccgttgcgcctaaatgatctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctg

SEQ ID NO: 157546 - DNA, 454 bp, Homo sapiens
  Payload ID: 10874
  Gene Symbol: NDUFB1
  Gene Name: NADH dehydrogenase (ubiquinone) 1 beta subcomplex, 1, 7kDa
  Uniprot ID: O75438
  ENST ID: ENST00000553514
  CDS Start-End: 207-383
cccgaggtcgcagcttccactggcgcgggttgagttccctgttgcccttggtctcggggtcgctgtaggcgctgaggctgcagagactcgctgtatcccccaggctggagtgtagtggcgtcatctcagctcactgcaacctctgcctcccgagttcaagcaattctcctgcctcagcctcctgagtaactgggactacagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctgaaat

SEQ ID NO: 157547 - DNA, 336 bp, Homo sapiens
  Payload ID: 10874
  Gene Symbol: NDUFB1
  Gene Name: NADH dehydrogenase (ubiquinone) 1 beta subcomplex, 1, 7kDa
  Uniprot ID: O75438
  ENST ID: ENST00000605997
  CDS Start-End: 92-268
ggtcccgaggtcgcagcttccactggcgcgggttgagttccctgttgcccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctga

SEQ ID NO: 157548 - DNA, 417 bp, Homo sapiens
  Payload ID: 10874
  Gene Symbol: NDUFB1
  Gene Name: NADH dehydrogenase (ubiquinone) 1 beta subcomplex, 1, 7kDa
  Uniprot ID: O75438
  ENST ID: ENST00000617122
  CDS Start-End: 33-350
agaggagtcaaccctgaggaggaaaaagtagtatgatttgctggcgtcacccctctgctccgtgcgggcgcggcgaatggcaggtcccgaggtcgcagcttccactggcgcgggttgagttccctgttgcccttggtctcggggtcgctgtaggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaatctg

SEQ ID NO: 157549 - DNA, 705 bp, Homo sapiens
  Payload ID: 10875
  Gene Symbol: NDUFB10
  Gene Name: NADH dehydrogenase (ubiquinone) 1 beta subcomplex, 10, 22kDa
  Uniprot ID: O96000
  ENST ID: ENST00000268668
  CDS Start-End: 118-636
gcgcagacgcagccgccctcggcgtcctctgtagcgggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 157550 - DNA, 830 bp, Homo sapiens
  Payload ID: 10875
  Gene Symbol: NDUFB10
  Gene Name: NADH dehydrogenase (ubiquinone) 1 beta subcomplex, 10, 22kDa
  Uniprot ID: O96000
  ENST ID: ENST00000543683
  CDS Start-End: 83-589
gggcgacctaggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctgtgcgtgccccacccacccccaaccccccaccatcctcctgaggcctgggggccagaaccattgcaaatcttccctcccctcccttgtgctcacttgactttgccccctttgcatgtagcagaggcctcggttcccagcttgtttccattgcttccccagatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 157551 - DNA, 628 bp, Homo sapiens
  Payload ID: 10875
  Gene Symbol: NDUFB10
  Gene Name: NADH dehydrogenase (ubiquinone) 1 beta subcomplex, 10, 22kDa
  ENST ID: ENST00000569148
  CDS Start-End: 74-559
aggccgcgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatcaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctg

SEQ ID NO: 157552 - DNA, 495 bp, Homo sapiens
  Payload ID: 10875
  Gene Symbol: NDUFB10
  Gene Name: NADH dehydrogenase (ubiquinone) 1 beta subcomplex, 10, 22kDa
  ENST ID: ENST00000570172
  CDS Start-End: 68-495
cgggacccggacggaggtagaggccagggcagcgcgtccgggagcggagtccgcgcccgccgccgccatgccggacagctgggacaaggatgtgtaccctgagcccccgcgccgcacgccggtgcagcccaatcccatcgtctacatgatgaaagcgttcgacctcatcgtggaccgacccgtgaccctcgtgagagaatttatagagcggcagcacgcaaagaacaggtattactactaccaccggcagtaccgccgcgtgccagacatcactgagtgcaaggaggaggacatcatgtgcatgtatgaagccgaaatgcagtggaagagggactacaaagtcgaccaagaaattatcaacattatgcaggatcggctcaaagcctgtcagcagagggaaggacagaactaccagcagaactgtatcaaggaagtggagcagttcacccagatcaggacctgggggcctacagttctgccaggaagtgcctggcc

SEQ ID NO: 157553 - DNA, 948 bp, Homo sapiens
  Payload ID: 10876
  Gene Symbol: NDUFB11
  Gene Name: NADH dehydrogenase (ubiquinone) 1 beta subcomplex, 11, 17.3kDa
  Uniprot ID: Q9NX14
  ENST ID: ENST00000276062
  CDS Start-End: 360-851
tttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagt

SEQ ID NO: 157554 - DNA, 1388 bp, Homo sapiens
  Payload ID: 10876
  Gene Symbol: NDUFB11
  Gene Name: NADH dehydrogenase (ubiquinone) 1 beta subcomplex, 11, 17.3kDa
  Uniprot ID: Q9NX14
  ENST ID: ENST00000377811
  CDS Start-End: 826-1287
gaccagcgtcgacgctcaccttctcggcccgggctgtcaaggaagggctcccagacatcacctctgcccgccgccacctcctccaactctcccagctcagccggagccggagcgcgcaacaaccaagtccgagactggaggcagatcggggggaggggagaagcgccaagcgcgctgccctcccagggaaactcactgccgcctactcccagccggccacagtcaccagctcaaaatggcgacgacgagaagggagtcggcgctccgaccaccatccacctactaaggaagcgcgctctggccggccccggcgattggtcaccgcccgctaggggacagccctggcctcctctgattggcaagcgctggccacctccccacaccccttgcgaacgctcccctagtggagaaaaggagtagctattagccaattcggcagggcccgctttttagaagcttgatttcctttgaagatgaaagactagcggaagctctgcctctttccccagtgggcgagggaactcggggcgattggctgggaactgtatccacccaaatgtcaccgatttcttcctatgcaggaaatgagcagacccatcaataagaaatttctcagcctggccgaaaatggttggccccacgaagccacgacaactggaggcaaagagggttgctcaacgccccgcctcattggaaaaccaaatcagatctgggacctatatagcgtggcggaggcggggcgatgattgtcgcgctcgcacccactgcagctgcgcacagtcgcatttctttccccgcccctgagaccctgcagcaccatctgtcatggcggctgggctgtttggtttgagcgctcgccgtcttttggcggcagcggcgacgcgagggctcccggccgcccgcgtccgctgggaatctagcttctccaggactgtggtcgccccgtccgctgtggcgggaaagcggcccccagaaccgaccacaccgtggcaagaggacccagaacccgaggacgaaaacttgtatgagaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtgaccagttgctaagtggggctcaagaagcaccgccttccccaccccctgcctgccattctgacctcttctcagagcacctaattaaaggggctgaaagtctga

SEQ ID NO: 157555 - DNA, 504 bp, Homo sapiens
  Payload ID: 10877
  Gene Symbol: NDUFB2
  Gene Name: NADH dehydrogenase (ubiquinone) 1 beta subcomplex, 2, 8kDa
  Uniprot ID: O95178
  ENST ID: ENST00000247866
  CDS Start-End: 74-391
cgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgagaa

SEQ ID NO: 157556 - DNA, 660 bp, Homo sapiens
  Payload ID: 10877
  Gene Symbol: NDUFB2
  Gene Name: NADH dehydrogenase (ubiquinone) 1 beta subcomplex, 2, 8kDa
  ENST ID: ENST00000476181
  CDS Start-End: 36-140
ggcggctggggaccgcggggcggacgggagcgagtatgtccgctctgactcggctggcgtctttcgctcgcgttggaggccgccttttcagaagcggctgcgcacggactgctggagatggtggagtccgtcagaactgaggcccaggaaatgaaaggagtgacttgcctgaagtcccacatggatgaagaatctggagctggggcaggtgtggggtgggcagaaggcaaagccctgtgtgacttgggcaaagacagtgatggagagccatgagcgacagcccttggtcctgcatgaggagatgggggaatgccgatcttccctgagtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgagaa

SEQ ID NO: 157557 - DNA, 503 bp, Homo sapiens
  Payload ID: 10877
  Gene Symbol: NDUFB2
  Gene Name: NADH dehydrogenase (ubiquinone) 1 beta subcomplex, 2, 8kDa
  ENST ID: ENST00000472695
  CDS Start-End: 268-393
ctcgaggagagggaccccgctggccggagggagagggagagacttcgctgggcagatgggacaccgtgtgcagggccgtcatgctagatcctgaatgaataatataattggtatatgaggacattacggaaacagtatgctacgtcattcaagttgtaaagtggcgatatttgtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatga

SEQ ID NO: 157558 - DNA, 420 bp, Homo sapiens
  Payload ID: 10877
  Gene Symbol: NDUFB2
  Gene Name: NADH dehydrogenase (ubiquinone) 1 beta subcomplex, 2, 8kDa
  ENST ID: ENST00000460088
  CDS Start-End: 182-307
gcgactcgaggagagggaccccgctggccggagggagagggagagacttcgctgggcagatgggacaccgtgtgcagggccgtcatgtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgagaa

SEQ ID NO: 157559 - DNA, 539 bp, Homo sapiens
  Payload ID: 10877
  Gene Symbol: NDUFB2
  Gene Name: NADH dehydrogenase (ubiquinone) 1 beta subcomplex, 2, 8kDa
  ENST ID: ENST00000475276
  CDS Start-End: 194-430
aggatcgcttgaacccaggaggcggaggttgcagtgagccaagattgttccattgcactccagcctgggtgacagagtgagactctcgcaaacaaacaaacaaagaaaacaaacagtcctagctaacatgtatcaagaaccactgccctgttactgttcacgaatctgtgcattatgaagacaagatattttaatgcacttttcctacagtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatg

SEQ ID NO: 157560 - DNA, 1666 bp, Homo sapiens
  Payload ID: 10877
  Gene Symbol: NDUFB2
  Gene Name: NADH dehydrogenase (ubiquinone) 1 beta subcomplex, 2, 8kDa
  Uniprot ID: O95178
  ENST ID: ENST00000476279
  CDS Start-End: 75-392
gcgggcggagcgccggggaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagtgggtagctagcaacatggaccacagatatactggtgactccgctctcctctggccaagctacaaatcatcacctgaggcagagatgctactaccctcttctggggctcaactaccgatgggcatcagtaatccatcccagtataacatttcaaggatgtgctggagacaatacatggactttctctttcaatggtgaggaatgaaacaagatacaagaaccacagcatggaatatgttttcttttacatccaatggccaggtcataaaggatgccttgagacctccaccctggcccccacagcgctttgggacaggatgactaacgcagtccagcttcatgtgcaatcaagtcccgggaagaaatttacatttcaaactctgaaaaatcagtgtctaggttggcagcagtactctggaaactgataaaaccaaattcggtcctatatttcaatttccccttctaagttaatacatgattgctgcccatcatacagtacttcaaccctaaactacagcaatttctgtcaacatttctgttgtataaaagttccatgctttgaagagcctatgggagtagaaaaagtttctctagaaatgtcactgaactatatttgcaacctagttgctctatgtgataaatatatctgactatactagggattatgtgctttaaaaaaataattttgttcactgaaaatttacctgtgtgttttctcattgttaaatgtgattttggctataaactctttagtgcatttacctatgcagtctaaattgcactctaaaaattattaacacagctgagttaaaccagagtggctgctctcttcacaaatcactgatttctgctaaaatgttagcttttttattgcatcatgaaggcacagtaagatcatttggcaaattgtcaaggtatttttctagagcctcacctacaccatttcaactcatgacctgtaagctatttgctgttcatactcacagtaaaccttccatctctggctatggtgtttatagcctaatggttggaatctgctcgtctcaaggtgctggtattcctagcactaacaatgccaacttggacaaagaagagaatcttgcaaaaagagtaatcattctaccctcttagctgggtggtctttctatgaatgcctgtgcatgtgacaaagctgcagcaaactcattatgaggatgtactgtcatgccaagcctactgaaaattaaaattacatcactgttagt

SEQ ID NO: 157561 - DNA, 1101 bp, Homo sapiens
  Payload ID: 10877
  Gene Symbol: NDUFB2
  Gene Name: NADH dehydrogenase (ubiquinone) 1 beta subcomplex, 2, 8kDa
  Uniprot ID: O95178
  ENST ID: ENST00000465506
  CDS Start-End: 56-373
agcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagtgggtgtgctccaaatttctttatgtcatatttaccttttttcataaacattagtttttactttgtgcctatgatggacttgaaaaaactgcatattctaacagcatgaagttgagttaaccatgtcctgtatctgcttttttttttttttttgagacagagtcttgctctgtcgcccagactggagtgcagtggcgtgatctgggctcactgcaacctctgccttccaggttcaagtgattctccttcctcagcctcctgagtagctgggattataggcacatgctaccacacttggctaatttttgtatttttagtagaggcagagttttgccacgttggccaggctggtctcgaacttctgacctcaagtgatctgcccacctcagactcccaaagtgctaggattacaggtgtgagccaccacgcctggccatgtatctgatttctgccttaagttttcacatttgctttggtctcttcttccttttcattgtatgttttattttatttacattttttattttgtagagacagggtgtcactatgttgcccaggctggtcttgaactcctgggctcaaatgattctcctgcctctgcctcccaaagtgctgggattacaggcatgtgccaccacacctggcccattgtataataaaaaaaaatttttttcctaagttaggttataattttaggg

SEQ ID NO: 157562 - DNA, 544 bp, Homo sapiens
  Payload ID: 10877
  Gene Symbol: NDUFB2
  Gene Name: NADH dehydrogenase (ubiquinone) 1 beta subcomplex, 2, 8kDa
  ENST ID: ENST00000482954
  CDS Start-End: 306-431
tctctctagtgtctttaagttgctgatgactcacaaggataaagttcctcattcctgtcttttagtgagcagtatggtttaggtggacagagattcctttggtgcagtttttttcaaggagctagatcctgaatgaataatataattggtatatgaggacattacggaaacagtatgctacgtcattcaagttgtaaagtggcgatatttgtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgagaa

SEQ ID NO: 157563 - DNA, 726 bp, Homo sapiens
  Payload ID: 10877
  Gene Symbol: NDUFB2
  Gene Name: NADH dehydrogenase (ubiquinone) 1 beta subcomplex, 2, 8kDa
  ENST ID: ENST00000464566
  CDS Start-End: 1-315
tccgctctgactcggctggcgtctttcgctcgcgttggaggccgccttttcagaagcggctgcgcacggactgctggagatggtggagtccgtcatgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaaggtctcattctgtcatccagactggagtgcagcgtgatcatggctcactgtaaccccaacctcctgagctcaagtgattctcccgcctcagccttctcagtagctgggactactactcttggctaatttttgtatattttgtagagatgaggttttgccatgttgcccaggctgatctcaaattcttggactcaagtgatccacctcttggcttcccaaagtgttgggattacaggtgtgagccagtgtacctggccaacaaatttgttttaatgactggactgtaaacccttgagagaggaagggtgattttgcttctcttgtctacaaggctgtcacatgatcagtgctcaataaatacttgaataattgaataaatgaa

SEQ ID NO: 157564 - DNA, 499 bp, Homo sapiens
  Payload ID: 10877
  Gene Symbol: NDUFB2
  Gene Name: NADH dehydrogenase (ubiquinone) 1 beta subcomplex, 2, 8kDa
  ENST ID: ENST00000471136
  CDS Start-End: 107-388
gaggcctagggagggcgcggtccagggtcccggtgcctggctgcggaatttagggtagagtctgttcggcagcctttaatcggagacgtcacgtggccgctttttaatgctgaaaaatcactctggctgcagggagtggaggctgtcgcccagagagagcgccgtcggtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaatgag

SEQ ID NO: 157565 - DNA, 559 bp, Homo sapiens
  Payload ID: 10877
  Gene Symbol: NDUFB2
  Gene Name: NADH dehydrogenase (ubiquinone) 1 beta subcomplex, 2, 8kDa
  ENST ID: ENST00000461457
  CDS Start-End: 58-348
gaagcgaagtaggcaggggcgaggcggctggggaccgcggggcggacgggagcgagtatgtccgctctgactcggctggcgtctttcgctcgcgttggaggccgccttttcagaagcggctgcgcacggactgctggagatggtggagtccgtcaagctagcaacatggaccacagatatactggtgactccgctctcctctggccaagctacaaatcatcacctgaggcagagatgctactaccctcttctggggctcaactaccgatgggcatcagtaatccatcccagtataacatttcaaggatgtgctggagacaatacatggactttctctttcaatggtgaggaatgaaacaagatacaagaaccacagcatggaatatgttttcttttacatccaatggccaggtcataaaggatgccttgagacctccaccctggcccccacagcgctttgggacaggatgactaacgcagtccagcttcatgtgcaatcaagtcccgggaagaaatttacatttcaaactctgaaaaatcagtgtctaggttggcagca

SEQ ID NO: 157566 - DNA, 482 bp, Homo sapiens
  Payload ID: 10877
  Gene Symbol: NDUFB2
  Gene Name: NADH dehydrogenase (ubiquinone) 1 beta subcomplex, 2, 8kDa
  ENST ID: ENST00000476470
  CDS Start-End: 250-375
aggcggaggaagcagcgtgcgcggcgggtgtggacgctcctggagcgaggcggggggcggcggcgctagatcctgaatgaataatataattggtatatgaggacattacggaaacagtatgctacgtcattcaagttgtaaagtggcgatatttgtgccggtggtggtgtgcacattgagccccggtatagacagttcccccagctgaccagatcccaggtgttccagagcgagttcttcagcggactcatgtggttctggattctctggcgcttttggcatgactcagaagaggtgctgggtcactttccgtatcctgatccttcccagtggacagatgaagaattaggtatccctcctgatgatgaagactgaaggtgtagactcagcctcactctgtacaagagccaggtgagaatttcaaggattatcgacttcatattgcacattaaagttacaaattaaagtggcttggtcaagaa

SEQ ID NO: 157567 - DNA, 755 bp, Homo sapiens
  Payload ID: 10878
  Gene Symbol: NDUFB3
  Gene Name: NADH dehydrogenase (ubiquinone) 1 beta subcomplex, 3, 12kDa
  Uniprot ID: O43676
  ENST ID: ENST00000237889
  CDS Start-End: 324-620
agtatgccggcagccccgccctgtgtgcggtgtctaaggattccgtccccaagcaaggacaacatattatcttccccgcccttctcttttctacagtatctgttacctcagtcagattgaggatgcacatatactgggaaaataatcgacttccagcgtccctcatgtagtctctacctgattcaggaatctctaacccagtatcggaacgttaagcggcttctccgctttcctgccgtgagaaactcgaggtgacaacctccgtttccggttggctccggttgcagagttgagtgtcctgagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 157568 - DNA, 462 bp, Homo sapiens
  Payload ID: 10878
  Gene Symbol: NDUFB3
  Gene Name: NADH dehydrogenase (ubiquinone) 1 beta subcomplex, 3, 12kDa
  ENST ID: ENST00000450023
  CDS Start-End: 268-462
acgaccctcccaagatgctacctggtttacgagaggttccgggaccaccaacacaccggctaccgcctttccagaccaccctcgccagctcccgtctgtagtttccgcggccgaaggagaagaaaacccctcttcatctagcactttgcctcccccaaagacagcaccgccgcctacctgtcaccctgctgtctccggcttcctaccgccgccgcctcccgcagcagcctgccaactgcagcgcaacaaccaaccctctcattggacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgat

SEQ ID NO: 157569 - DNA, 547 bp, Homo sapiens
  Payload ID: 10878
  Gene Symbol: NDUFB3
  Gene Name: NADH dehydrogenase (ubiquinone) 1 beta subcomplex, 3, 12kDa
  Uniprot ID: O43676
  ENST ID: ENST00000454214
  CDS Start-End: 116-412
gagtgtcctgagaggtcagattgctgtcaggtgcttgttcccgcttctgccacacgcaaaattgtctttgtttgcctttggatcgcaaaggcagaagaacagcatcactaaaaacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatatatgccaa

SEQ ID NO: 157570 - DNA, 503 bp, Homo sapiens
  Payload ID: 10878
  Gene Symbol: NDUFB3
  Gene Name: NADH dehydrogenase (ubiquinone) 1 beta subcomplex, 3, 12kDa
  Uniprot ID: O43676
  ENST ID: ENST00000433898
  CDS Start-End: 78-374
ggttggctccggttgcagagttgagtgtcctgagaggtcagattgctgtcaggcagaagaacagcatcactaaaaacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaactctccaaaataagatttcttctctgtagcctacttgtctggtttatcccttacagaatattagtaagatttaatcaattaaaatatatatata

SEQ ID NO: 157571 - DNA, 671 bp, Homo sapiens
  Payload ID: 10879
  Gene Symbol: NDUFB4
  Gene Name: NADH dehydrogenase (ubiquinone) 1 beta subcomplex, 4, 15kDa
  Uniprot ID: O95168
  ENST ID: ENST00000184266
  CDS Start-End: 52-441
gacaaagggcctcagaatcgcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaagtagtagtttctctttcttagtattaccttgattcaatgttaaaaactattaacaccctaacaacacagaagcagacgcagcccgtgttgggaatctgctgtcagagtgacagcaaacatttgctgtacattgaatgaatgaacataaacttcattaaactgtgagctctta

SEQ ID NO: 157572 - DNA, 821 bp, Homo sapiens
  Payload ID: 10879
  Gene Symbol: NDUFB4
  Gene Name: NADH dehydrogenase (ubiquinone) 1 beta subcomplex, 4, 15kDa
  ENST ID: ENST00000461682
  CDS Start-End: 6-215
ccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgtgagtgtggggcctcccaggcgggaatagggcccgagtcctgggagagaccgagagagaccacgcaaagggtcggccaccgctcccgatcagtatctcagacgcaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaaaacctattaatactctacggacagagaagcacaagctgcctgtgtg

SEQ ID NO: 157573 - DNA, 558 bp, Homo sapiens
  Payload ID: 10879
  Gene Symbol: NDUFB4
  Gene Name: NADH dehydrogenase (ubiquinone) 1 beta subcomplex, 4, 15kDa
  ENST ID: ENST00000491335
  CDS Start-End: 4-213
aagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgtgagtgtggggcctcccaggcgggaatagggcccgagtcctgggagagaccgagagagaccacgcaaagggtcggccaccgctcccgatcagtatctcagacgcaggaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggataggaaagaaaaacttatccaggaaggaaaattggatcgaacatttcacctctcatattaagtctggcaatgatgactatatgtattcctgcctaaataaatcatctattaatcattaa

SEQ ID NO: 157574 - DNA, 309 bp, Homo sapiens
  Payload ID: 10879
  Gene Symbol: NDUFB4
  Gene Name: NADH dehydrogenase (ubiquinone) 1 beta subcomplex, 4, 15kDa
  ENST ID: ENST00000492739
  CDS Start-End: 14-256
ctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgataggaaagaaaaacttatccaggaaggaaaattggatcgaacatttcacctctcatattaagtctggcaatgatgactatatgtattcctgcctaaataaatcatctattaatc

SEQ ID NO: 157575 - DNA, 1426 bp, Homo sapiens
  Payload ID: 10879
  Gene Symbol: NDUFB4
  Gene Name: NADH dehydrogenase (ubiquinone) 1 beta subcomplex, 4, 15kDa
  Uniprot ID: O95168
  ENST ID: ENST00000485064
  CDS Start-End: 33-395
gcgcaggcgcaattgtgccctggttcgccaagatgtcgttcccaaagtataagccgtcgagcctgcgcactctgcctgagaccctcgacccagccgaatacaacatatctccggaaacccggcgggcgcaagccgagcggttggccataagagcccagctgaaacgagagtacctgcttcagtacaacgatcccaaccgccgagggctcatcgaaaatcctgccttgcttcgttgggcctatgcaagaacaataaatgtctatcctaatttcagacccactcctaaaaactcactcatgggagctctgtgtggatttgggcccctcatcttcatttattatattatcaaaactgagagggtaagtattcagaccagatgtttagtatttgagtgataggttcactttctagggaccagctgcagctccttctcttgaagattgccaccagtgcccctcccaccttggggctgtcctctgccttcccttcctctcttcttttatctttattcctttccagcaggagttaaaacagaaagttttcagtcacctttgtctatttttgttagttcatttgttttttaaaaagatgatgtttattgggttaagtattagcagaatacataaatcatttagtacgtttcctgtttgcgtgaattctatttatgttggtcacattttgcaaattaatgttaaaacctattaatactctacggacagagaagcacaagctgcctgtgtggggaatagctgccgtcagcagcctgggtatatgattggagagaaagtcaagctgatctttggcaccaaaccattccacatctggtactaaaccctgagctgcagcccccaggcttgtgttgccactggagcccactcgtctagctttgtctttaactggcccatctgcattcccattagagttcgtgtattttgattatctggtgaatgatctacttaacagaaaggtagtccacattttcccagaaagtgtttgcattttgctttcaatatatggttttatgggataatatatttctaatgactaaaatgtgagtaagatgtttttgaataggagcattttcttactgtgtctttagttcctcggattactgtttcttcgcacactccctgggctttagacagtgggattgcaattaggtttggagtgtttcattctgtttgtcagttgtacggtgggttgtgccaaaatgcagtttttcttaccttttttatttatttatttttatctaatatagccaactggcagaatatattgtctttaatgtactttttttctgtctttacaggataggaaagaaaaacttatccaggaaggaaaattggatcgaacatttcacctctcatattaagtctggcaatgatgactatatgtattcctgcctaaataaatcatctattaatca

SEQ ID NO: 157576 - DNA, 1141 bp, Homo sapiens
  Payload ID: 10880
  Gene Symbol: NDUFB5
  Gene Name: NADH dehydrogenase (ubiquinone) 1 beta subcomplex, 5, 16kDa
  Uniprot ID: O43674
  ENST ID: ENST00000259037
  CDS Start-End: 115-684
atagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagt

SEQ ID NO: 157577 - DNA, 1054 bp, Homo sapiens
  Payload ID: 10880
  Gene Symbol: NDUFB5
  Gene Name: NADH dehydrogenase (ubiquinone) 1 beta subcomplex, 5, 16kDa
  ENST ID: ENST00000359944
  CDS Start-End: 6-134
tagccatggcggccatgagtttgttgcggcgggtttcggttactgcggtggcagctctgtctggccggccccttggcactcgcctcggatttgggggcttcctcactcgtggctttccgaaggctgctgggtaattcaatattcccagctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttta

SEQ ID NO: 157578 - DNA, 671 bp, Homo sapiens
  Payload ID: 10880
  Gene Symbol: NDUFB5
  Gene Name: NADH dehydrogenase (ubiquinone) 1 beta subcomplex, 5, 16kDa
  ENST ID: ENST00000482604
  CDS Start-End: 1-620
tgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattggctctatacgaacaaagtagaggcttagaaaatgggagattgtctggaccatctgccacgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaatt

SEQ ID NO: 157579 - DNA, 729 bp, Homo sapiens
  Payload ID: 10880
  Gene Symbol: NDUFB5
  Gene Name: NADH dehydrogenase (ubiquinone) 1 beta subcomplex, 5, 16kDa
  ENST ID: ENST00000480374
  CDS Start-End: 1-303
gggtttcggttactgcggtggcagctctgtctggccggccccttggcactcgcctcggatttgggggcttcctcactcgtggctttccgaaggctgctgggtaattcaatattcccagctcctgttcgacacagtggagaccatgggaaaagactatttgtcatcagaccttctagattctatgacaggcgttttttgaagttattgagattctacattgcattgactgggattccagtagcaattttcataactctggtgaatgtattcattgcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactccta

SEQ ID NO: 157580 - DNA, 744 bp, Homo sapiens
  Payload ID: 10880
  Gene Symbol: NDUFB5
  Gene Name: NADH dehydrogenase (ubiquinone) 1 beta subcomplex, 5, 16kDa
  ENST ID: ENST00000472629
  CDS Start-End: 16-549
ctgcccgtagtagccatggcggccatgagtttgttgcggcgggtttcggttactgcggtggcagctctgtctggccggccccttggcactcgcctcggatttgggggcttcctcactcgtggctttccgaaggctgctgcccctggtaaccaccattctgctgtctttatgattttgactactctatttctcatattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataa

SEQ ID NO: 157581 - DNA, 684 bp, Homo sapiens
  Payload ID: 10880
  Gene Symbol: NDUFB5
  Gene Name: NADH dehydrogenase (ubiquinone) 1 beta subcomplex, 5, 16kDa
  ENST ID: ENST00000471112
  CDS Start-End: 1-171
attccagtagcaattttcataactctggtgaatgtattcattggtcaagctgaactagcagaaattccagaaggctatgtcccagaacactgggaatattataagggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtt

SEQ ID NO: 157582 - DNA, 4046 bp, Homo sapiens
  Payload ID: 10880
  Gene Symbol: NDUFB5
  Gene Name: NADH dehydrogenase (ubiquinone) 1 beta subcomplex, 5, 16kDa
  Uniprot ID: O43674
  ENST ID: ENST00000493866
  CDS Start-End: 26-439
cttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtttataatgctttcatggtttttttttttgccatgtattgttcttttttaaactacacacagacacacagacacgtacacacacacacacacacacacacacacacacgctcttttcctagatgcaatctctgggatcccttagagtccttttttggggaagtagttgcactaggtaatgtgattcctgcagagattataaaatgtgagtaaaagctaaaaatgactcatttattaagcatttattgtctgctagacactatattaaataactgcattttttaacattattttcttttctttttttttttttttttttttgacgaaatcttgcactgtcacccaggctagagtgcagtgccgtgatctcggctgcaacctccgcctcccgggttcaagcaattcttgtctcagcctcccaagtagctgggattacaggcacccaccaccacacccggctaatttttgtatttttcagtaaagactgtttcgctgtgttggccaggctggtcttgaacttctgacctcaggtgattggcctgtctccacttcccaaagtgctgattacaggcctgagccactgcacccaacattattttcaaaatgacaagaggtagtatttagtacctgaggctcagatgttaaacacaaactcagtatttacaaaaataaacatttaaaacatttacacttcaacttccaaaatggctttttaccataaacattcaggattttcaaacctgtaacagcttatcaatgcatctcatcttagaagtatgttttacattcttcataaaaataaaaatgaacccaggcttcctaagattcaggccagtgggtctccacttaaggccaaatggagaaataattttttgctgcctaaacacacaagtgaattgaaaagccacaggccattcattcaacaaataactttattatttttattgataatgtacttgtaatgtgctattttgatacatgtatgcaaagtataatggtcaaatcagggtatttgaatatacatatatttcaaaatatagttatatatttcaaaataagatatagcaagttagaagtatatataagtatattattatatgttattgttaactataatttacctactgtactatcaaatactagaacttattccttgtatctaaatgtattcttgtaaccattaactaacttttctgaatttcctactctccccttcccttcccagccttgtaaccacctttctactctgcctccatgagacccattttttaatctcccacatatgagtgagaacattcaatatttgtctttctaggcttggcttatttcacttacattaatgacctccagttccatccatgttgctacaaatgacagaatcccattctttttcataatattgtccatacataccacattttctatatccatttatctgttgatggacacaggttgcaaagggattgctggattgtatgataattctatgtgtagtttcttgaggaaccttcatggtgttcttcatagtggttgtactactgtacattcctaccaatggtggatgagcgttcccctttctccacatcctcacaagcatttgttattttttcttttttttcaaatgaacattttaactggggtgagatatcttaatgtggtattggtttacatttccctaattatggttgagcattttttcacatatctaatggccattcatatgtcttcctttgagaaatgtctatacagatctctggccctttttttaaattttttttttttttgaattggggtcacccagtctggaggtgatctgggcttccacatcctgggctcaagtgatcattccacctcaggatgacccaaatagctaggaccaaaggcgagtgccaccatgctcagctaatttttttgtattttttgtagcgactgggtttcaccatgttgcccaggctggtcttgaactcctgtgctcaagtgatccgctcaccttggcctctcaaagtgcaggtactttaggcgtgcctggcctttttgtccattttatttttttgagatggagtcttgctgtgtcacccaggctggagtgcagtggtgcgatctcgactcagtgcaacctccgcctcccaggttcaagcaattctcctgcctcagcctcctgagtagctgggattacaggtgtgcaccaccacacccagctaatttttttgtatttttagtagagagggggtgtcaccatgttggccagggtgatcttgaacttctgaccttgtgatccacccaccttggtctcccaaagtgctgggattacaggtgtgagccactgcgcccagcctgtccattttttaatcaggttatgggttttttgctattgaattgtttgagttccttatatattctggttatgaatcccttgttagatggtgtgttaggccattcttgtgttgctataaagaaaatcctgagtctgggtaatttataaagaaaaaaggtgtaaatggctcatagttctgcagactgtacaggaagcatggcaccagcattgcttggcttctggggaggcctcaaggaactttcactcatagcagaaagcaaagcaggagcaggcacatcacatggcaagagagcaagagagagaggtggaggagatgccacacactgttttaaacaaccagatctctcaggaactcattgttgttagaaaaggaattaaaagaaatcaaagagtgtgtaagcagaaactcagttgtacgtaagaaaacccaattccccctgagaaagagaaagagctggagtcctttaaaaattcactgcctgtttttctggtggctagtgagtgttagctctcctcccttcccaggcattgtgaagaccctgtttccctagctgtgcagctgcaaggtcactagacagataaactcaagtcgcaaaacatgtttttccttgaaaagtaagaaatgatgtaatgcatgtcttgactgaataactgtctttgtttcttgcttctgtaatatgcttccccctgcacagatctccccctgccccacgaaatgcttaaaagctaacttaactctttgttcagggctcagtcctttggatgttaatctgactgggccggagcacctaaataataaatattctcctgaacccca

SEQ ID NO: 157583 - DNA, 824 bp, Homo sapiens
  Payload ID: 10880
  Gene Symbol: NDUFB5
  Gene Name: NADH dehydrogenase (ubiquinone) 1 beta subcomplex, 5, 16kDa
  ENST ID: ENST00000468210
  CDS Start-End: 8-208
agtagccatggcggccatgagtttgttgcggcgggtttcggttactgcggtggcagctctgtctggccggccccttggcactcgcctcggatttgggggcttcctcactcgtggctttccgaaggctgctgagattctacattgcattgactgggattccagtagcaattttcataactctggtgaatgtattcattggtcaagctgaactagcagaaattccagaaggctatgtcccagaacactgggaatattataagcatcccatatcaagatggattgcccgtaatttctatgatagtcctgaaaagatatatgaaagaacaatggccgtccttcagattgaagctgaaaaggctgaattacgggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcct

SEQ ID NO: 157584 - DNA, 951 bp, Homo sapiens
  Payload ID: 10880
  Gene Symbol: NDUFB5
  Gene Name: NADH dehydrogenase (ubiquinone) 1 beta subcomplex, 5, 16kDa
  ENST ID: ENST00000611971
  CDS Start-End: 30-437
ctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcaattttcataactctggtgaatgtattcattggtcaagctgaactagcagaaattccagaaggctatgtcccagaacactgggaatattataagggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagttt

SEQ ID NO: 157585 - DNA, 666 bp, Homo sapiens
  Payload ID: 10881
  Gene Symbol: NDUFB6
  Gene Name: NADH dehydrogenase (ubiquinone) 1 beta subcomplex, 6, 17kDa
  Uniprot ID: O95139
  ENST ID: ENST00000350021
  CDS Start-End: 100-441
gttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgac

SEQ ID NO: 157586 - DNA, 1366 bp, Homo sapiens
  Payload ID: 10881
  Gene Symbol: NDUFB6
  Gene Name: NADH dehydrogenase (ubiquinone) 1 beta subcomplex, 6, 17kDa
  Uniprot ID: O95139
  ENST ID: ENST00000379847
  CDS Start-End: 103-489
ggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggtccatggggtatacaaaaagagtatctttgttttcactcatgtacttgtacctgtctggattattcattattacatgaagtatcatgtttctgaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgacttggaaaacggtatggaaaagtatttagttacatgtttgtttgtttttttcttacacagtacttacactaatttggtatcagggtatgcaacagtgaaatatcacaataaacaaatgtaagaacagcaattccatgcacttttgttttaaggaaatctttccggccaggcgcagtggctcatgcctgtaatcccagcactttgggaggccgaggcgggcagatcacgaagtcaggagatcgagaccatcatggctaacacagtgaaaccccgtccctactaaaaatacaaaaaaattagccgggcgtggtggcgggctcctgtagtcccagctactgcggaggctgaggcacgagattggtgtgaacccagaaggcggagcttgcagtaagccgagatagtgccactgagcctgggcgacagagcaagactccgtctcaaaaaaaaaaaaagctttccgaatcatttttgaagaatttagaaacttgattgaaaagcttattccaactatgatctgacactcaagactgtcagatttaggttgctgttaattttgtcatgagaatgtaaaatactaaaatctctaagtgaaaaatttgcatactagtgcttgttataaaggataatgcaaaaataaacttgggaactttgca

SEQ ID NO: 157587 - DNA, 761 bp, Homo sapiens
  Payload ID: 10881
  Gene Symbol: NDUFB6
  Gene Name: NADH dehydrogenase (ubiquinone) 1 beta subcomplex, 6, 17kDa
  ENST ID: ENST00000366466
  CDS Start-End: 125-418
gtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaattctggaataaatttttggagaataaatccccttggaggaaaatggaaaaaccatatggcatagttgaaaagaagtccagaatattccctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcatatctgttttcaagcattgtacaatttgagactgagtaatttaacaataagtaaaaagtggacatgctaaacaaatatgagagactacctactttttctggtcattcttgacttggaaaacggtatggaaaagtatttagttacatgtttgtttgtttttttcttacacagtacttacactaatttggtatcagggtatgcaacagtgaaatatcacaataaacaaatgt

SEQ ID NO: 157588 - DNA, 531 bp, Homo sapiens
  Payload ID: 10882
  Gene Symbol: NDUFB7
  Gene Name: NADH dehydrogenase (ubiquinone) 1 beta subcomplex, 7, 18kDa
  Uniprot ID: P17568
  ENST ID: ENST00000215565
  CDS Start-End: 63-476
gtggttccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaa

SEQ ID NO: 157589 - DNA, 529 bp, Homo sapiens
  Payload ID: 10882
  Gene Symbol: NDUFB7
  Gene Name: NADH dehydrogenase (ubiquinone) 1 beta subcomplex, 7, 18kDa
  ENST ID: ENST00000593353
  CDS Start-End: 63-275
gtggttccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgatggtggccacacagcaggagatgatggacgcgcagctgaggctccagctgcgggactactgcgcccaccacctcatccggctgctcaagtgcaagcgtgacagcttccccaacttcctggcctgcaagcaggagcggcacgactgggactactgcgagcaccgcgactatgtgatgcgcatgaaggagtttgagcgggagcggaggctgctccagcggaagaagcggcgggagaagaaggcggcagagttggccaaaggccagggacccggggaagtggaccccaaggtggccctgtagggggtgcaccccccaccctatggaccagtcaaataaaagccttcaggcccctcaa

SEQ ID NO: 157590 - DNA, 671 bp, Homo sapiens
  Payload ID: 10883
  Gene Symbol: NDUFB8
  Gene Name: NADH dehydrogenase (ubiquinone) 1 beta subcomplex, 8, 19kDa
  Uniprot ID: O95169
  ENST ID: ENST00000299166
  CDS Start-End: 14-574
gaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgtta

SEQ ID NO: 157591 - DNA, 684 bp, Homo sapiens
  Payload ID: 10883
  Gene Symbol: NDUFB8
  Gene Name: NADH dehydrogenase (ubiquinone) 1 beta subcomplex, 8, 19kDa
  Uniprot ID: O95169
  ENST ID: ENST00000370320
  CDS Start-End: 14-532
gaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgtgtaggcaccacttctcttacaatttaggctttctctctgccttgggctgagtgaggaagaggagtgctgttcctgccttcctagcccagctgggtctgaccagaggctactgtgtacccatttaccatgcgtgattgttaactcagagtggggtgtagccaggtattgactgaatgtatgttcttgctgacctgtgtttttt

SEQ ID NO: 157592 - DNA, 713 bp, Homo sapiens
  Payload ID: 10883
  Gene Symbol: NDUFB8
  Gene Name: NADH dehydrogenase (ubiquinone) 1 beta subcomplex, 8, 19kDa
  Uniprot ID: O95169
  ENST ID: ENST00000370322
  CDS Start-End: 152-619
ttggcttcccaactgcgtatttaaaccccgcccctgttgaacccttcggcttttcttcactcccggcttcctccgtcacgtttggcccggctcagccgccgtgacaggcctttgcgcatgtgcagaagggaaacgtgaagaagcctcccacatgaccaaggacatgttcccggggccctatcctaggaccccagaagaacgggccgccgccgccaagaagtataatatgcgtgtggaagactacgaaccttacccggatgatggcatggggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtg

SEQ ID NO: 157593 - DNA, 608 bp, Homo sapiens
  Payload ID: 10883
  Gene Symbol: NDUFB8
  Gene Name: NADH dehydrogenase (ubiquinone) 1 beta subcomplex, 8, 19kDa
  ENST ID: ENST00000528425
  CDS Start-End: 20-235
aaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggccgccgccgccaagaagtataatatgcgtgtggaagactacgaaccttacccggatgatggcatggggtgagacagagagggtatggcgactacccgaagctccctgaccgctcacagcatgagagagatccatggtatagctgggaccagccgggcctgaggttgaactggggtgaaccgatgcactggcacctagacatgtacaacaggaaccgtgtggatacatcccccacacctgtttcttggcatgtcatgtgtatgcagctcttcggtttcctggctttcatgatattcatgtgctgggtgggggacgtgtaccctgtctaccagcctgtgtgtaggcaccacttctcttacaatttaggctttctctctgccttgggctgagtgaggaagaggagtgctgttcctgccttcctagcccagctgggtctgaccagagg

SEQ ID NO: 157594 - DNA, 711 bp, Homo sapiens
  Payload ID: 10884
  Gene Symbol: NDUFB9
  Gene Name: NADH dehydrogenase (ubiquinone) 1 beta subcomplex, 9, 22kDa
  Uniprot ID: Q9Y6M9
  ENST ID: ENST00000276689
  CDS Start-End: 85-624
ccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtc

SEQ ID NO: 157595 - DNA, 789 bp, Homo sapiens
  Payload ID: 10884
  Gene Symbol: NDUFB9
  Gene Name: NADH dehydrogenase (ubiquinone) 1 beta subcomplex, 9, 22kDa
  ENST ID: ENST00000518008
  CDS Start-End: 57-593
gcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggtgcgttctacttgtacttcgttattccttagctatgtagatggagtgaagttttgctccccacaagcagaggtccagattccagccatgacagttactctgggcccttgcttctcagatatactttagtatctaagtgtatcaatttaacatttataatcaccttacaagtaagttaaagtgcattccctggtcgttttggctttgtctttgattttgcttcagatctccttctctttagtcctttgtctgacttttttgccttcttgctatactttccctcaacctgcctctccactattttcttaggcatttttcagtcatg

SEQ ID NO: 157596 - DNA, 636 bp, Homo sapiens
  Payload ID: 10884
  Gene Symbol: NDUFB9
  Gene Name: NADH dehydrogenase (ubiquinone) 1 beta subcomplex, 9, 22kDa
  ENST ID: ENST00000517367
  CDS Start-End: 44-550
agtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggt

SEQ ID NO: 157597 - DNA, 1319 bp, Homo sapiens
  Payload ID: 10884
  Gene Symbol: NDUFB9
  Gene Name: NADH dehydrogenase (ubiquinone) 1 beta subcomplex, 9, 22kDa
  ENST ID: ENST00000522532
  CDS Start-End: 48-713
gtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagagcaacttagtaaaagacaagtaagacaggagctggggaccatggaagaaacatcccatgtgctttatcgaagtgccaagttgggaccacgggccgggctagaacgatccatggaaaagttctgtgctcaggggaacaactcaaattcagacattttgctagggctaagggaaatgagctggtaccttcgaatcagcttccagaacgcctgcagtgcaagttctcaattacggcatgcaaatgatttccttaaaaattaagtctaaattgattcattgaggctcttggatattcatctcatggtcaccccttagtactcggctacaacagtgagtctcaaaaccacctggagtgctcctttaaaacacagacgactgggtccccacccccagaggtttggacttggtgggtctgggttgggcccaagaacttgcatttctagccagttcccacgtgatgctgctgacctggggacctcactttgagaaccaccctgctgggccttcttgacttggtgagacaaagtaacggggaacaagtggtactagaacagtgaatgaggagtgagctacatggccatcaacttgcactgaatcgctggtctgtacaggagataccaccatcatgattcctgacagtagattctccatgactcaacagtggatggataaaattagaaggaagccacctctacaccagcagtttaaaccttctggagttttccattaacttacaatcactggccgcagcatagagatgaaggtacagaatcggccacgttcttcaatcaaagccttccggacagcctgcttttctgtttcttccaataagagatacttatcattgacatcttggagagcactgtc

SEQ ID NO: 157598 - DNA, 717 bp, Homo sapiens
  Payload ID: 10885
  Gene Symbol: NDUFAB1
  Gene Name: NADH dehydrogenase (ubiquinone) 1, alpha/beta subcomplex, 1, 8kDa
  Uniprot ID: O14561
  ENST ID: ENST00000007516
  CDS Start-End: 67-537
gcgcgccgccggaaaggaaccctggtccggaggcggcggcgcagtgcatcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaacattttccccca

SEQ ID NO: 157599 - DNA, 843 bp, Homo sapiens
  Payload ID: 10885
  Gene Symbol: NDUFAB1
  Gene Name: NADH dehydrogenase (ubiquinone) 1, alpha/beta subcomplex, 1, 8kDa
  ENST ID: ENST00000484769
  CDS Start-End: 14-238
ggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcagcaccttctgcctgtgtccaggactcctggaagtaattctaggaaacaagccaagtgacctttgaccaataaggatttgaattgcgcgggtccacttatatgcggattttttttcaaccaaacgcgaccagtatttacgggatgtgccgccccgcgtataaggagggcaggctcttcctataagcggattctgcaaggctgactgcgggacgttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaa

SEQ ID NO: 157600 - DNA, 503 bp, Homo sapiens
  Payload ID: 10885
  Gene Symbol: NDUFAB1
  Gene Name: NADH dehydrogenase (ubiquinone) 1, alpha/beta subcomplex, 1, 8kDa
  ENST ID: ENST00000562133
  CDS Start-End: 1-335
tcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaa

SEQ ID NO: 157601 - DNA, 885 bp, Homo sapiens
  Payload ID: 10885
  Gene Symbol: NDUFAB1
  Gene Name: NADH dehydrogenase (ubiquinone) 1, alpha/beta subcomplex, 1, 8kDa
  Uniprot ID: O14561
  ENST ID: ENST00000570319
  CDS Start-End: 2-472
catggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcaggtaaatagacttaaaaaatgatgttcacccatagatttgtctgtggttcttcaataaaggaaacttaagaagaaacagaaaatggaaatgcttgaccaagatttttcactacttataaaatgcaagccctttcctgttgtctgccactcaaaggggcccagccctggtggtgatctttgagaggttgagaactgtcattcctggatagaactcccttgattgtcagctgtcctcacaaaagcagaacattgtacaaagtactgaacagggtaacctggaaacagacctctgtctccctcaattactcagccaaggtaagcccagcctgctgggtaagacactgaagtgacctggctcttaagtaggcaagagaggcctcatgtataagaggatggactttggagt

SEQ ID NO: 157602 - DNA, 520 bp, Homo sapiens
  Payload ID: 10885
  Gene Symbol: NDUFAB1
  Gene Name: NADH dehydrogenase (ubiquinone) 1, alpha/beta subcomplex, 1, 8kDa
  ENST ID: ENST00000567761
  CDS Start-End: 311-520
cagagatccagttagaaggagcagcaagaccttccaggaggccatgctggaaggacatggggtgaggaggatacctaaccttcccttgcctcagtttctcatctgtaaaaaggagggtgatagtatcatggatctcaccagaatactggagagctgaagaaagatgatgtgtgtaaagtgcaatatcatagcctgagctgataagaaattaatggaggccgggacgtggtggcttatgcatgtaatcccagcactttgagaggctgaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgt

SEQ ID NO: 157603 - DNA, 598 bp, Homo sapiens
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENST ID: ENST00000394223
  CDS Start-End: 286-516
ccagaaacgagaacaacggaggcagaggagctgaagactccagtatgcaactgactacaaggagatgcagtttcacatacagctgggtactccaagtgtacagttcccatcagctctaatatgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatg

SEQ ID NO: 157604 - DNA, 761 bp, Homo sapiens
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENST ID: ENST00000394228
  CDS Start-End: 335-565
cctcccgagaagagtgacggggtggggctgtttcccgctcggaaactaagaaataaatgcctcatccctactccagaaacgagaacaacggaggcagaggagctgaagactccagtatgcaactgactacaaggaggtttgtgaggcttcagtatgatcgtgagtgtaagtgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcatattgtgacaa

SEQ ID NO: 157605 - DNA, 809 bp, Homo sapiens
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENST ID: ENST00000505036
  CDS Start-End: 404-634
ctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttc

SEQ ID NO: 157606 - DNA, 628 bp, Homo sapiens
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENST ID: ENST00000503997
  CDS Start-End: 18-248
gagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtacatctctgcgccggatgtcatctaacagattccctggatcatctggatcaaatatgatttattatctggttgtaggcgtcacagtcagtgctggtggatattatgcttacaagacagtcacatcagaccaagccaaacacacagaacataaaacaaatttgaaagaaaaaacaaaagcagagatacatccatttcaaggtgaaaaggagaatgttgcggaaactgagaaagcaagttcagaagccccagaagaacttatagtggaagctgaggtggtagatgctgaagaaagtcccagtgctacagttgtggtcataaaagaggcatctgcctgtccaggtcacgtggaggctgctccgg

SEQ ID NO: 157607 - DNA, 725 bp, Homo sapiens
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENST ID: ENST00000539387
  CDS Start-End: 299-529
cctcccgagaagagtgacggggtggggctgtttcccgctcggaaactaagaaataaatgcctcatccctactccagaaacgagaacaacggaggcagaggagctgaagactccagtatgcaactgactacaaggagacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcatattgtgacaa

SEQ ID NO: 157608 - DNA, 1198 bp, Homo sapiens
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENST ID: ENST00000539002
  CDS Start-End: 772-1002
aagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcatattgtgacaa

SEQ ID NO: 157609 - DNA, 1257 bp, Homo sapiens
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENST ID: ENST00000544855
  CDS Start-End: 831-1061
aagagtctcgcacactgtgtgatcatcgtttgagcccaaagtgctaaaatacaggtgtaggtgtttgagaagcgctgtagttgattatggacgaaatgcctaatttaaggagcagaggcggagtggaaaatgaaaaaagcttcaccgcagtggagacttgttaacagccctggggagaaaggggcttaacagagtctggaaatcgtgaaagagcttgaccgatgaaatgggcctggctgtcgtatcggtaatttggtgaatgttgcttaagatcagcctggaaaggtagttagtcagatccgaagtgacatatttgcactgccaaaggaggctctggaggttaaagtatgtgttttaatttcgttgttgaggccatataatgcagagttgacggaccgaccttatgagtcaccttggagcggagtagtggagacttaaagacagactaccctggagctggcttcaaactagttcttaatattgtgactcgaactccccatccccagaaattctcagatcttagaagccaaagactggcaaggatactagagggaactactcgagtaggcgaggtcagactacataccgaataggagtccttccaaaaatatgcagtttcacatacagctgggtactccaagtgtacagttcccatcagctctaatatgacagaaggctgaggccggggtgctagagaaccttgccgtgctggaattcacgttgacgcccccacggagctctgctgcagagccctcgagtcccgcacttccggccgccaggtggcgctggttctgttgccaactcggagagactgagctgggccacgcaagatggcgccgtccgccttgctgcgtcccctttcccggctgctggcccccgccaggctcccgagcggcccttcagtgcgatcaaagttctacgtgcgagagccgccgaatgccaaacctgactggctgaaagttgggttcaccttgggcaccactgtcttcttgtggatctatctcatcaaacaacacaatgaagatattttagagtacaaaagaagaaatgggctggaataaacttttgaaacactaatgtagtatgctccgtatagtgattgtagctgttcctctggattcaccatctgttgagttgtaaatgtgagagaaaaagttatatgtgaatatatatcaagccagcatttgtattttgcatcattaaataaaaagaaataaaaatacttctgtattcttcagataaagcatattgtgacaa

SEQ ID NO: 157610 - DNA, 2518 bp, Homo sapiens
  Payload ID: 10887
  Gene Symbol: NDUFC2
  Gene Name: NADH dehydrogenase (ubiquinone) 1, subcomplex unknown, 2, 14.5kDa
  Uniprot ID: O95298
  ENST ID: ENST00000281031
  CDS Start-End: 476-835
tagcttttatggaatttcaattaattacgtttatcaaaactacgcatcatgcccatttgtgggtattggatgaaaagataaatctttccagaaggggcaggggagggagaggcaattctggttggggaagttgggagaaaagaaaatcagtatctcctagtcttcgcccagtttggctcgtttggggtactcctcgaccccgcgttaccaggcccgtgaatcccactcccaccagagaattagcgcgggcggacgagcaaagtgaaacttagtagcccggaacttcgcgtgccgggttcccgcagcaacacgtaccgggaagcgtttgggcgctgcaccgcgctgcgccgtgcccgtgagtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctacataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtatttttttttttttttttgagacgacagtcttgctctgtcatcaggctggagtgcagtggcgcaatttcggctcactgcaacctccacctcctgggttcaagcaattctcctgcctcagcctcccgagtagctgggactacaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaatacaaggctttggattttttattagttctgcaataaataataggttta

SEQ ID NO: 157611 - DNA, 422 bp, Homo sapiens
  Payload ID: 10887
  Gene Symbol: NDUFC2
  Gene Name: NADH dehydrogenase (ubiquinone) 1, subcomplex unknown, 2, 14.5kDa
  ENST ID: ENST00000534029
  CDS Start-End: 76-291
ccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctgataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtaccatg

SEQ ID NO: 157612 - DNA, 1888 bp, Homo sapiens
  Payload ID: 10887
  Gene Symbol: NDUFC2
  Gene Name: NADH dehydrogenase (ubiquinone) 1, subcomplex unknown, 2, 14.5kDa
  Uniprot ID: O95298
  ENST ID: ENST00000527806
  CDS Start-End: 98-364
aggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacttgaagcttatgctaatctgtatgttgacaccttgtaattaaaatacgtaccatgagtactctgactctttattgttgtaagaaaaatagttcatcatcagagaatggtcagtttccattcacccatctgaaagattttaagatgaggttgaattctagtttagagttagcagactacccaaatctggcccactgccaataaagtctcattggaacacagccatgctcatttgtttacatgttgtttatggcgactgccatgctgcaagagcagaattgagtagttgtgatagagacctatggcctgcaaagcctaattaatatgtagccctttcagaaaaggtttgcctgcccctgtcctagtgcaaagtgaatttagagtgagccagattatggaggattctgtgactcttgccaaataattttgacttcatcctgtaggtattaagtcattaaggcgttttaaatcatacagtcaggtttgtatttctgagctgtctataatgaatgatatagaaggtggtttcgaaggaggagactccagacaaggaaaacagaaatcttatgttgccaagttgtctttgctcttaggtgggttatcctggagaaaatggactcaggagctaatactgtctacagtggagcttggtgcaattagaagcaaaagactgtacctaactggaatgaggttactttttatggcttatcaaatgcttgtcctggcccgatgcagtggctcatgcctgtaatcccagcactttgagaggctgaggcagggcagattgcatgagcccaggagttcgagaccaacttgggcaacatggtgaaacactgtctctacataaaatacaaaaattagctgggcgtggtggcacgttcctgcaatcccagctactcataaggctgaggtgggaggatctattgagccctggaattcgaggatgcaattaattgtggttgtgtcacagttcactgcagcctgggtgacactccagcctgggtgacaaaggagaccccgtcaaaaaaaaaagtacttgtcccaaaagtttttgtttcctagcttagaatttataatcagattaggttttggagataaagtatatgtggtatttttttttttttttttgagacgacagtcttgctctgtcatcaggctggagtgcagtggcgcaatttcggctcactgcaacctccacctcctgggttcaagcaattctcctgcctcagcctcccgagtagctgggactacaggtgcatgccacgacgcccagctgatttttgtgtttttagtagagacggggtttcaccatgttggccaagatggtctcaatctcttgaccttgtgatccacctgccttggccttccaaagtgttggaattacaggcgtgagccaccgcgcctggtctatatgtgatttcaaattaggtggccttataaatataagcagatggtttctgggcaaaatcaaatgatttctgtctctattttcttgagtaccaattgtaaaaactgaaattaggttgaggaaagtgctttagaaataataaagatgtacaaatac

SEQ ID NO: 157613 - DNA, 495 bp, Homo sapiens
  Payload ID: 10887
  Gene Symbol: NDUFC2
  Gene Name: NADH dehydrogenase (ubiquinone) 1, subcomplex unknown, 2, 14.5kDa
  Uniprot ID: O95298
  ENST ID: ENST00000525085
  CDS Start-End: 76-366
ccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctgactacctgtatgctgtgagggaccgtgaaatgtttggatatatgaaattacatccagaggattttcctgaagaagataagaaaacatatggtgaaatttttgaaaaattccatccaatacgttgaagtcttcaaaatgcttgctccagtttcactgatacctgctgtttctgaatttgatggaacatgtttcttatgacagttgaagcttatgctaatctgtatgttgacaccttgtaattaaaatacgtacca

SEQ ID NO: 157614 - DNA, 561 bp, Homo sapiens
  Payload ID: 10887
  Gene Symbol: NDUFC2
  Gene Name: NADH dehydrogenase (ubiquinone) 1, subcomplex unknown, 2, 14.5kDa
  ENST ID: ENST00000528164
  CDS Start-End: 118-441
agtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaaggtatttcaagttaattttagataatctgtgtttactgtattattattttccctggttaatcttatccatgtgtatggctttagataccttctaaattctgttgactcccacatcttagtctatagaccaaaatt

SEQ ID NO: 157615 - DNA, 1461 bp, Homo sapiens
  Payload ID: 10888
  Gene Symbol: NDUFAF1
  Gene Name: NADH dehydrogenase (ubiquinone) complex I, assembly factor 1
  Uniprot ID: Q9Y375
  ENST ID: ENST00000260361
  CDS Start-End: 383-1366
aagcggcggcaggccggcggttggtgtgtcccgggtgtggggaggcgacagagccctggcacttgagggttgagggggcctccccagcgcggcgaaccgtctagcctccggaggccaggccgtgagtgcgggaggtatacgccaaggcggaagaattttgccactcactacctgtgtgacctcgggtaaattagccttggaacgtcagtttcttcgtctctataattgaaataataatagtacctctctcaggattgttgtgagccgtcagtgaaacacttagagcagtttctggcacatggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaagattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaagaatttgcctatgaaaattctccagagcttaacccaaggctttttaaataaagatcatatggtagttttgttttactaatctaagggtactagcatctacaatgatatagacaaaataaaatatttctttaatggcatccaaccaa

SEQ ID NO: 157616 - DNA, 1585 bp, Homo sapiens
  Payload ID: 10888
  Gene Symbol: NDUFAF1
  Gene Name: NADH dehydrogenase (ubiquinone) complex I, assembly factor 1
  ENST ID: ENST00000559127
  CDS Start-End: 398-1183
taggctcggggaggtaagcggcggcaggccggcggttggtgtgtcccgggtgtggggaggcgacagagccctggcacttgagggttgagggggcctccccagcgcggcgaaccgtctagcctccggaggccaggccgtgagtgcgggaggtatacgccaaggcggaagaattttgccactcactacctgtgtgacctcgggtaaattagccttggaacgtcagtttcttcgtctctataattgaaataataatagtacctctctcaggattgttgtgagccgtcagtgaaacacttagagcagtttctggcacatggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcgggggaccctactggcaggaggtcaaggcaactctgctaaagttggtgtcctaggcctgcgtggtggctcacacctgtaatcccagcactttgggaggccaaggcggacggatcacttgaggttgggagttcgacaccagcctgaccaacatggagaaaccctgttgtctctactaaaaaaaatacaaaattagctgggcgtggtggcgcatgcctgtaatcccagctactcgggaggctaaggcaggataattgcttgaacccaggaggcggaggtttcgattcctttttccaaatttttcttctctaatcgaggaagaatccgggatgttcagcatgagcttccgcttgataagatctcttctataggattcaccttggctgataaagtggatggtccattcttcctggagatagattttattggcgtgtttactgatccagctcatacagaag

SEQ ID NO: 157617 - DNA, 781 bp, Homo sapiens
  Payload ID: 10888
  Gene Symbol: NDUFAF1
  Gene Name: NADH dehydrogenase (ubiquinone) complex I, assembly factor 1
  ENST ID: ENST00000560978
  CDS Start-End: 155-781
ggaagggaaaagcagatggacctatacgggtaaagtggcttctgggcggaaggtacactataggctcggggaggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaaggggtgcttttgagaggaagatgtcttacgattggtcccagttcaatactctgtat

SEQ ID NO: 157618 - DNA, 837 bp, Homo sapiens
  Payload ID: 10888
  Gene Symbol: NDUFAF1
  Gene Name: NADH dehydrogenase (ubiquinone) complex I, assembly factor 1
  ENST ID: ENST00000558719
  CDS Start-End: 265-837
gcggcggcaggccggcggttggtgtgtcccgggtgtggggaggcgacagagccctggcacttgagggttgagggggcctccccagcgcggcgaaccgtctagcctccggaggccaggccgtgagtgcgggaggtatacgccaaggcggaagaattttgccactcactacctgtgtgacctcgggtagaattgggctatttgctgaagcttcttggtggcccttgctagcccaggaagaaacttacattttgatttttttgtaccatggctttggttcacaaattgctgcgtggtacttattttctcagaaaattctctaagccaacttctgccttgtatccatttttgggtattcgctttgcagagtattccagtagtcttcagaaaccagtggcttctcctggcaaagcctcctcacagaggaagactgaaggggatttgcaaggagatcaccagaaagaagttgctttggatataacttcttctgaggagaagcctgatgttagtttcgataaagcaattagagatgaagcaatataccattttaggcttttgaaggatgaaattgtggatcattggagaggaccggaaggccaccctctgcatgaggtcttgctggaacaagccaaggttgtctggcaattccgggggaaagaagatttggataagtggacagtgacttctgataagacgattggaggcagaagtgaagtgtttttgaaaatgggcaagaataaccaaagtgcactgctatatggaactctgagctctgaggcgcctcaggacggggagtctacccgaagtgggtactgtgcaatgatatccaggattccaagg

SEQ ID NO: 157619 - DNA, 719 bp, Homo sapiens
  Payload ID: 10889
  Gene Symbol: NDUFAF2
  Gene Name: NADH dehydrogenase (ubiquinone) complex I, assembly factor 2
  Uniprot ID: Q8N183
  ENST ID: ENST00000296597
  CDS Start-End: 128-637
gttactagaagggctccaggatggaggccgacctgacttctccgcctcggtgggctgggtcggcggctggagcattacccctactgcgggtcccgctgctggcagcgctggaaactgggtggacggcatgggttggtctcaggatttgttccgcgccttgtggagatcgctgtcaagggaagtgaaggagcacgtgggcacggaccaattcgggaacaaatactactacatcccgcagtacaagaactggagaggacaaactattcgagagaaaagaattgtagaagcagcaaataaaaaagaagtagactatgaagcaggggatattccaacagaatgggaagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagttatttaccttgta

SEQ ID NO: 157620 - DNA, 586 bp, Homo sapiens
  Payload ID: 10889
  Gene Symbol: NDUFAF2
  Gene Name: NADH dehydrogenase (ubiquinone) complex I, assembly factor 2
  ENST ID: ENST00000511107
  CDS Start-End: 50-232
ccctactgcgggtcccgctgctggcagcgctggaaactgggtggacggcatgggttggtctcaggatttgttccgcgccttgtggagatcgctgtcaagggaagtgaaggagcacgtgggcacggaccaattcgggaacaaatactactacatcccgcagtacaagaactggagaggtgaggtggcggcgtgggcagcgattgcgtggtcagtgattgcgagcttggattagaagaacaagaaagactccacctactatggaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtta

SEQ ID NO: 157621 - DNA, 461 bp, Homo sapiens
  Payload ID: 10889
  Gene Symbol: NDUFAF2
  Gene Name: NADH dehydrogenase (ubiquinone) complex I, assembly factor 2
  ENST ID: ENST00000502658
  CDS Start-End: 1-155
aattcgggaacaaatactactacatcccgcagtacaagaactggagaggacaaactattcgagagaaaagaattgtagaagcagcaaataaaaaagaagtagactatgaagcaggggatattccaacagaatgggaaggaaatactaaagaatgaaaaacacagagaagaaatcaaaataaaaagccaagatttttatgaaaaagaaaaactccttagtaaagagaccagtgaggaactcctgcctccaccagttcaaactcaaattaaaggccatgcctctgctccatactttggaaaggaagaaccctcagtggctcccagcagcactggtaaaacctttcagccaggatcctggatgccacgagatggcaagagccacaatcaatgaatgcattatggtcaaatcttttcatgtatatggatgtgactattttaacaaataaaagaagtgaaaagtta

SEQ ID NO: 157622 - DNA, 705 bp, Homo sapiens
  Payload ID: 10890
  Gene Symbol: NDUFAF3
  Gene Name: NADH dehydrogenase (ubiquinone) complex I, assembly factor 3
  Uniprot ID: Q9BU61
  ENST ID: ENST00000326912
  CDS Start-End: 207-590
ctccccagggttccagagatggccaccagcctcggctctcccacgtctacacccatcacctccagcctgagggcgcaactgagaggaactgagacccaagcagctcagtaaaggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctccc

SEQ ID NO: 157623 - DNA, 2012 bp, Homo sapiens
  Payload ID: 10890
  Gene Symbol: NDUFAF3
  Gene Name: NADH dehydrogenase (ubiquinone) complex I, assembly factor 3
  Uniprot ID: Q9BU61
  ENST ID: ENST00000326925
  CDS Start-End: 1135-1689
cgcgcccgtggggccggagaggaagtaaacccgcgcgtccacctcggggacacccccgcgctcggtggcctttgtccggtgacgctgccagcgcccggagcaccaggggccgaaggggtccacagagcagccgcgggacccccggaaacccattgcgaccggccccaggagacccaccaccaggctcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaaggtgatgctccacgcgcttctacttcaagtctggtccggttcggcctggtctgggccagccgaacagccacccaaacactatcacagcttgcccttccgcttgctctggctgcctgcagacttggagccattttaaggagaaaccacctggccacgccccctagagaacccgagaagccaatccacgctcggccacgcccctctccgcgcgctgcggagaggccaacggtcgcgcgggtgacggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccaggtgggcggtcgccccgccccgggagcgcggcttaatagctgagagcccgggggccaggccgcggctgcggcccaggcaacgccctgagggtggccacgctgccaggtgttccactcccccgggactatgggcaagggcccggggcggggagggcggcaggtgctgacactggagctgcgccggaggtcggggaactcggcctcctaagactgaggacactcgcctgctgggccggtcgagctgtgcggtgccctccgggacgcagggggcgctgcagccacgctgggtcaggctccgcagggccctcccaacccggggactaacggcgccggtgacgacttcgccgcgcgttggtcagccatggccaccgctctcgcgctacgtagcttgtaccgagcgcgaccctcgctgcgctgtccgcccgttgagcttccctgggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctcccattttgtatcaggtgtgttgctggccaggagctgatggctcactgggctcttggaggggaatgtgaagaaaccaaggagtcactttttcatctagattacttaggattccttgacttttcagaagtcgggaagcagtatgtttgcctgttgtagacctacttgctcacatgcagatttgagaggacctcaacggcttttctcacaaaa

SEQ ID NO: 157624 - DNA, 808 bp, Homo sapiens
  Payload ID: 10890
  Gene Symbol: NDUFAF3
  Gene Name: NADH dehydrogenase (ubiquinone) complex I, assembly factor 3
  Uniprot ID: Q9BU61
  ENST ID: ENST00000395458
  CDS Start-End: 310-693
caccaccaggctcccactgtgccgagcttcccgctcgcccggccccgcgggtagcgaaagcgacaatgttcccctgaggccacgacagagccggcgtgccgagatgcccaaaccccgcgcgggggccagcgactctcgcgccagtaggcccttgacttggatcaagacgggggacgggggactcccaggacgcgagcagagtgaacgaggacaagggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctccc

SEQ ID NO: 157625 - DNA, 774 bp, Homo sapiens
  Payload ID: 10890
  Gene Symbol: NDUFAF3
  Gene Name: NADH dehydrogenase (ubiquinone) complex I, assembly factor 3
  Uniprot ID: Q9BU61
  ENST ID: ENST00000451378
  CDS Start-End: 275-658
gcgcgctgcggagaggccaacggtcgcgcgggtgacggttagggcggggcgtgcttccgcgtctagccggagaaacttgagccggctgccccgcccacggtgcccgaagccccaaaggctggaattaggggctagaagtctggcacccaccgcctggccaggtgttcgggacgcgaccagggccccgcggcgagggcatcggctctcgccggcggatgacgagctgtatcagcggacgcgcatctctctgctgcaacgcgaggccgctcaggcaatgtacatcgacagctacaacagccgcggcttcatgataaacggaaaccgcgtgctcggcccctgcgctctgctcccgcactcggtggtgcagtggaacgtgggatcccaccaggacatcaccgaagacagcttttccctcttctggttgctggagccccggatagagatcgtggtggtggggactggagaccggaccgagaggctgcagtcccaggtgcttcaagccatgaggcagcggggcattgctgtggaagtgcaggacacgcccaatgcctgtgccaccttcaacttcctgtgtcatgaaggccgagtaactggagctgctctcatccctccaccaggagggacttcacttacatctttgggccaagctgctcaatgaaccgccaggaactgacctgctgactgcactctgccaggcttcccaatgctttcactcttatctaccctttggcacttatcttgcttatcaacataataatttatacacttctccca

SEQ ID NO: 157626 - DNA, 2399 bp, Homo sapiens
  Payload ID: 10891
  Gene Symbol: NDUFAF4
  Gene Name: NADH dehydrogenase (ubiquinone) complex I, assembly factor 4
  Uniprot ID: Q9P032
  ENST ID: ENST00000316149
  CDS Start-End: 81-608
atgctccgggtgtcccggagttgtcctgcgccggtgttcccacgtgcggcctgaacctgagcgcataatgttatgaggagatgggagcactagtgattcgcggtatcaggaatttcaacctagagaaccgagcggaacgggaaatcagcaagatgaagccctctgtcgctcccagacacccctctaccaacagcctcctgcgagagcagattagtctctatccagaagttaaaggagagattgctcgtaaagatgaaaagctgctgtcgtttctaaaagatgtgtatgttgattccaaagatcctgtgtcttccttgcaggtaaaagctgctgaaacatgtcaagagccgaaggaattcagattgccgaaagaccatcattttgatatgataaatattaagagcattcccaaaggcaaaatttccattgtagaagcattgacacttctcaataatcataagcttttcccagaaacctggactgctgagaaaataatgcaggaataccagttagaacagaaagatgtgaattctcttcttaaatattttgttacttttgaagtcgaaatcttccctcctgaagacaagaaagcaatacgatcaaaatgaagaaaatcacagaaatttcctatgtgtactcctcatccctcctgctgtatattttctcattttttgcgtaataaattatgttaattaccaaatatttaatgctctcattgtgagggcatactcttaatatttattgagctccctgacttttcaagattgccatagaatatcttttgttttattttaatttggtttaggcatatttcataagtgcatgtcagcatgactgagcacatctgtacctttattatggtgaaagagttaatttgttattttaggcacatataccaacttttaaattggtcatattaccccttgggaaatgtcctgaatccctcaactgagttttactttccaagttaggtgtttagttcattcttctcatgcgatagtgaaagtaaaagctttcctgacccttaagactgacattttctcgttagggaaagagactcgatagcagggtagactaacagtagttcccaaataaaggcacacaggagaaaatgaatcaatagaatctaattaaaattactactccagggaataagaagtattgaggatttattttattttgaattggttttaagtatggaataattgtctttacagttataaaaagtaattagtggtgtttacaaaatgttgggaatttctgctttgacagataggtaagtcccatgggaatttctgctttgacaaatagttaagtcccatggccttcagagaggcaggaagcagaaactttcaaaaaagtaacatttctctggatttaatgtggaaatagagaaaaatttaaagaataattaaaaaaccatggtagatgaaatttggtgattacatatagtttcggatgttaatgctagttgagagaagagaaaaagatagcaagtagaagcagagaacaggatcattggaagggacctgagaaattgccatttcatccattttagcaaatttaattagcatagcatgtaccagtactaggatcttgagtgagtgtgtgagtttagctctgcctaatatattactacttgggggatctttgggagactatatcttcttggagattgagtttcttctataaaataagcataatgctaccctaaatgtaagggttatcatgaagataaataataaaggactacaaaggaccaagcaaataggaattattttttgcggtggagaaacaagtgcctggggagaatatatgaccgaagattctgtagtttatgacttaaacaggcccagaatttagtttttcaaatcctagtagtgtgttttttctgtcttgccaaaaagcagcacacctcaaagaagggaaaaggtgtgaattgtgggtatattagggttattagtgcttccgagggaagataggcatcactacttcccagagatgcccctggaaatgatatagaggatgttgaagaattcaatgtgatgacggaatgaggcatttgtagtaatgctgagaacagaaaaatggactaagtggaaaatttgtaagcatgactttgaatgtagatttgttatgtgaacaaactacctagtttatttttagttcaatacaataattgttttaagaaaacatgaaataactactcaatataaaatgcattttaaaactgtaaataagtcaaaactttattctttttatcataatggtcactagctgagtcacaaatactagtacactcttctgagccatcttctttattcatatctacattgtgtggttaggcatctgttatgtggtgtcacatgataaaataaagaacttcttcccataccatt

SEQ ID NO: 157627 - DNA, 5529 bp, Homo sapiens
  Payload ID: 10892
  Gene Symbol: NDUFAF5
  Gene Name: NADH dehydrogenase (ubiquinone) complex I, assembly factor 5
  Uniprot ID: Q5TEU4
  ENST ID: ENST00000378106
  CDS Start-End: 120-1157
ggcaagcgaactaggccaaactacttgcacgttccctcgagaagatctttggagtagacacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaatgtcgtccagaattttcatcagaaatggatagctttaacatctaaaattattatattttgaagcaagaagcactctaagctatttactaataggcttttcatataattaggaaaacctaatatcacatctatagtaaccatttcagtttcatattgtttctgttctcataaggatactgctgagtgtctttgcagattcagcctaaaagcaaagaaaatatttccctaaaatatttgcaaataatgttcacatatgtaaatgccttggaaaatattactcatgctgaccttttacacctttttcatttgtcatactgttttctttgccttgaagaggaacagatgaatatgcaccttctccagagttatgtggttttagaatttagaagagcatgtatctttattaaatccctcctcaactctttttttttaaagcatctgaatttaaccttatttcttttttatctccatggtgtgggtgggaccaccatggttttacaccccaccctaccttagggaagaagaaaacattttaaagaataccagaagtagaatcacatgtaacagtctctgcacagtcatcagtttattgttaagctttcctttgtaatttcagggcttaagcactattatcctaatccaagttcacagtcctgttgttgtcgaggagggttcaaaatcatttggagataatcaagctcagacagcttaggataggtgagaagaacatagaggaagcagggagaaggctgagaagcaagcaggagtgagcgctaagtgttttgtttccagttagctgttcgctgtcttttccatttaacctgggcactgccctagcctcatcttcagccttcagtgatctataatagcatttccttctgtctcctctcagtctctcttctgccttccttccctcctttactgtattagcaacaagctgtccatgggtgggggctgtgtgttagcctgtacgtagcacatgggactttccacatagtagatattcagttacattttgaactaattatataacaaacttgccctttgaaagactaagttatagttaaaaaccaagatttgtaggagaaaaagaaattattgttcccttcagtttgaaaaatcatcgatatttgaaactgggatacgcttggtagcttttttgttttaacacaaagtaaacctgtgaagtagaatttggcgttttgttttttggggttttttttttttttagcttaattttcagaacttgaagagagagaacaacaacaaaaaacaaactgcgctagccaggtgcaatggcgcatgcctgtagtcccagctacttgggaggctgaggcaggcaggagttcaaggctgcagtgagctgtctgtgccacggcactccaacctgggcaaaagaggagacctcatctaaagaaaaatccaccaaaaaccctgtgttttaaagtgcaaactgatgatggaggaatgggtaaattccaggggtctatatttccaaaaggacatgtgtttttgtgcactaatacttgtttttgaagaacacatctcagtgttaagtggctgttgctgaggaaggggactgaggaactgggtgtgtctgtgtcattctgtttgaatgtctgtcaggggtatagaaactaggagggagacttgtacttttcactttttaaacttcctgtaaaatttgaattttccaagcaagaatattacttttgcttatttaatgtcaacggaattatatgtggatggtggggtggagctaaggattactctactctggctatcccaaaaaaagctccatttgtttaaaaaaattaagtaaatcaaacacagctaattgaggacccttattgtttaatgtgagtgattgtagtgaaaacacttattttagtgtgtataacactagtgaaattatttttgtagttaaatctgctggaagtgtgctattaagcttttattgtttggagccctcaggaaactaatttttctgaataaccacattttccaaatgattaagagctcatccttttaagcaatgaaacttttaaaaggtctttatcaaaaatttttcataaatgttacattcttaaatggtatatgataaataatcatcttttttgttggtttatttttttattttttattttattttattttttgagacggagtctcgctctgtctccaggctggagtacagtggcgcaatctcggctcactgctgcctccgcttcctgggttcaagtgattcttcctgcctcagcttcccaagtagctgggattacaggcgcgtgccaccacgctggctaatttttgtatttttaatagagatggggtttcaccatgttggccaggatggtctcaatctcttgaccttgtgatctgcccaccttggcttcccaaagtgctgagattacaggtgtgagccaccaggcctggccaataaccatttcttgataaccccacagataatatcataaactcaagttgtctgtattgcttcttcccagactggtcccaagaatgctgtggttggttttgtgtcttttccagcacttttcttacttgctgtcagttgtcaatctcaacaccttgaccaaaatgaactttcttgagtcatttcttctctgtttagctataagattagaattcatactgaaagatttctaggacttttgtattaaggtaggaaagaggaactaggttctgggagaaagactcctttggaataaaattcatgagctttattggttcctttaacagatcttcattgagtttcatgtgccaggcatccaactagtctctgcttttatagttgtcagtctgacagggctctagtatgtgcacaccgtgacacctgttggctgccaggagactgtttggcttatttcctggttcttagcaatattccaggttggcctggagaattccaaaggtaaatatgaaaatgtatacctacaaaagaatttttgctttataggaagaatttgtaggatttattgagatgtaagctacctatatacatcaagtatgtgatatgattgtaaaaagttacagaagtgtgtgagtcatgaagtacctgtgagggaagtttatatattttttcaaactcttttagtaccattttcatccactaggtggaagcaattacagtatgacctgcattaaagacatgtacagttttttggccggctgcagtggctcacacctgtgatctcaacactttgggaagctgagacgggaggattgcttgagcccaggagtttgagaccagcttgggcaacgtgatgaaaccctgtctctacaaataaaaaaaaaattagccaggcatggtggcacaagcctgtggtcccagctactcagaaggctgaggtgggagtattgatcgagcccaggaggtcaaggctgcagcaagctgtcgcaccactgcactctagcctgggcaacagcaagaccctcgtctcaaaaaagaaaaaaaaaaagtacaatttttgtattgattatgtattccttaagtaggagtggaataaaagtattttaccgtggattggcttctgtgaaggaaagaagtgaatattagtagatatttggaaaaaagaaagatagttgatgcagtgattattattctgttcctttgtaagttaccattagcctctcttgcttaagaaatattttgagcttttttggggaggggttgtggttaatgatgtgaaattaatcttcaggaaatttatcataagcagacttgccttttcagatattggtatattttaattctctacctgaatacatacatgacagttattttaccatgctggtttaaaaaacatcaatttgaaaatactagaaggtggggtgaacactgataagttactgttaacaaataagaaaataatgctttgccatctgtggtggttttaaaatctatccacaaatttttgatatgcttctctttaagacgggacacttcattcccctctaagtacaggctgagtttagtgattcccttccaacaaatagatggtgtgtcacttctgagactaggtaataaaaggcattgcatcctccttactctctcttggatccttcactctagggaaagccagcagccatattgtaaggccactcaactccatggagaagacctagaagtgaggagcagaggcctccagccaaaagccatgtgagggagccatcttggaagcaattctccaggcccaaacttcagatgactgtggtcccagccaatgcattgaccacaacctcatgagagaccctgagctagaaccacctagctaagccactctcaaatatcttatctacagaaactgagatgataaatgtttgtggtttaagc

SEQ ID NO: 157628 - DNA, 991 bp, Homo sapiens
  Payload ID: 10892
  Gene Symbol: NDUFAF5
  Gene Name: NADH dehydrogenase (ubiquinone) complex I, assembly factor 5
  Uniprot ID: Q5TEU4
  ENST ID: ENST00000463598
  CDS Start-End: 20-973
attggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataagcttcagttattccattgcaggaaactattggaaagtttttccaagctgacattgcagaaaatgctttgtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaa

SEQ ID NO: 157629 - DNA, 2409 bp, Homo sapiens
  Payload ID: 10892
  Gene Symbol: NDUFAF5
  Gene Name: NADH dehydrogenase (ubiquinone) complex I, assembly factor 5
  ENST ID: ENST00000378081
  CDS Start-End: 63-866
acacaaaagccgcgctggcgcatgcgcacaaaaagcgccggcaattggggtcgcagctggagatgctgcggccggcagggctctggcgcttatgtcggcgaccttgggcggcgagggtcccagcggagaatcttggccgtagggaagtcacctctggtgtctctccccgcggtagcacctcgcccagaaccctgaatattttcgaccgggatttgaaaaggaaacagaagaactgggcagcccggcagcccgagccgaccaaatttgactacctgaaggaggaggttggaagtcggatcgcagaccgtgtatatgacatacccagaaatttcccccttgctttggatcttggttgtggaagaggttacattgcacaatatttgaataaggaaactattggaaagtttttccaagctgacattgcagaaaatgctttgaaaaattcctcagaaacagaaatacctactgtcagcgttttagctgatgaagaattccttcccttcaaagaaaatacatttgacctggtggttagcagtttaagtttgcattgggtgaatgaccttcctagagcacttgagcagattcattatattttaaaaccagatggagtgtttatcggtgcaatgtttggaggcgacacactctatgaacttcggtgttccttacagttagcggaaacggaaagggaaggaggattttctccacacatttctcctttcactgctgtcaatgacctgggacatctgcttgggagagctggctttaatactctgactgtggacactgatgaaattcaagttaactatcctggaatgtttgaattgatggaagatttacaagaacaaaagtccagaatgttgacctaattttacaaaacaagctgcatatcagctgatgaatgcatgagaaattttcaaggctttcacagtggtcttaaggtatgggtgagagtaactgtgcttggaatagaaaagccctgctgcatcgagacacaatgctggcagctgcggcagtgtacagagaaatgtacagaaatgaagatggttcagtacctgctacataccagatctattacatgataggatggaaatatcatgagtcacaggcaagaccagctgaaagaggttccgcaactgtgtcatttggagagctaggaaaaataaacaaccttatgccaccggggaaaaaatcacaataaatatttattcagtgttaatgtcgtccagaattttcatcagaaatggatagctttaacatctaaaattattatattttgaagcaagaagcactctaagctatttactaataggcttttcatataattaggaaaacctaatatcacatctatagtaaccatttcagtttcatattgtttctgttctcataaggatactgctgagtgtctttgcagattcagcctaaaagcaaagaaaatatttccctaaaatatttgcaaataatgttcacatatgtaaatgccttggaaaatattactcatgctgaccttttacacctttttcatttgtcatactgttttctttgccttgaagaggaacagatgaatatgcaccttctccagagttatgtggttttagaatttagaagagcatgtatctttattaaatccctcctcaactctttttttttaaagcatctgaatttaaccttatttcttttttatctccatggtgtgggtgggaccaccatggttttacaccccaccctaccttagggaagaagaaaacattttaaagaataccagaagtagaatcacatgtaacagtctctgcacagtcatcagtttattgttaagctttcctttgtaatttcagggcttaagcactattatcctaatccaagttcacagtcctgttgttgtcgaggagggttcaaaatcatttggagataatcaagctcagacagcttaggataggtgagaagaacatagaggaagcagggagaaggctgagaagcaagcaggagtgagcgctaagtgttttgtttccagttagctgttcgctgtcttttccatttaacctgggcactgccctagcctcatcttcagccttcagtgatctataatagcatttccttctgtctcctctcagtctctcttctgccttccttccctcctttactgtattagcaacaagctgtccatgggtgggggctgtgtgttagcctgtacgtagcacatgggactttccacatagtagatattcagttacattttgaactaattatataacaaacttgccctttgaaagactaagttatagttaaaaaccaagatttgtaggagaaaaagaaattattgttcccttcagtttgaaaaatcatcgatatttgaaactgggatacgcttggtagcttttttgttttaacacaaagtaaacctgtgaagtagaa

SEQ ID NO: 157630 - DNA, 1869 bp, Homo sapiens
  Payload ID: 10893
  Gene Symbol: NDUFAF6
  Gene Name: NADH dehydrogenase (ubiquinone) complex I, assembly factor 6
  ENST ID: ENST00000396111
  CDS Start-End: 371-1096
cctttctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggagccacctctcaacaacccatgaagtgtctggagctccaccctctgctcaagaggaacggcacatgacccaggcctatgccaatcagcatttcacattcctcatggttggttcaaaggaaacgggattatgaaggttatttatgctccctgctgctccctgcagaatcccgaagctctgtttttgcactgagggcctttaatgtggaactggctcaggctggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcattgatgttaattctagtctattagttttataaaagttaggattcttatttaggaacaacaggaaatgactgttaaggagaaaatgaatttattgaatgggatgtcaagtagctcacaaaattgagaagttgccgtgggactagggtgccaagactgctgagattctggcagaggcactgccattggcacccctggcccagacagtgtctgctgtgctgtccctggaagctggagctccaacagggaatattggtgtagctgtgcataggccataagccacacttgagccagtgggcagggagaaggaatgtcattctcccttcaccactggggaaggaaaggggaaagggctcaagttatcataggggcttacatgctgagcagctataacctaggtgttcagaacacctggaagatgcatttatttaggggtcacaaatagtgaaattaatatttgaggaatatcagtcacgtgttgtgggcttttatccttaacgtttaatttttacaatcttgtgtaaaaatttatccatgataataacataacttctttaaggttggagtggctggcaagagcagagccttaatttgactttagctctggctggtctggaagcttttacttttttgttaatcccacttcctcactctgtcattcagcattatcatgatcgtgaacaaaattgtactgagaaagtttgtataagtgatatgaacggtattgtattgaacatccattaaagggttgctacacttta

SEQ ID NO: 157631 - DNA, 2549 bp, Homo sapiens
  Payload ID: 10893
  Gene Symbol: NDUFAF6
  Gene Name: NADH dehydrogenase (ubiquinone) complex I, assembly factor 6
  ENST ID: ENST00000396113
  CDS Start-End: 1051-1776
cgcctggccaagtgcggctctgctctccccagtcccggtccgcgaccacccggagcccgctccgccggccttgcgcggcgcgcccagggaaggcatttccagcccgcccacccaggactgttctagaaaaagtcttaaaggcctaccctcctactgatgacccagagactgtccctgcccagtcactgctactgttgaccttggctcctgcccagggatggaggctctcaactgggctggttctacatggaggtctcttcttcggcctttctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggtggaggttggggagaaaagagataatggtatggtgagatgtctactgaactgctcctgccaaggcccctccccatgtactctcaacgaaagttgcagccacccattctcattttgtggatataattccctgctttagttttctgagcacaagaaatcaactttggctgcacattggaatatctgagaagcttaaaaatactgatgtttggaccaggtgcagtggctcacgcctgtaatcccagcactttgggaggcagaggcagccacctctcaacaacccatgaagtgtctggagctccaccctctgctcaagaggaacggcacatgacccaggcctatgccaatcagcatttcacattcctcatggttggttcaaagtgaagcaactttcccagaagcaccacagtggacttgttctcaagtctaattggccagatcagggaaatatgcactgtcctggaccagtcactggtgatgaaagggtaacacccaccaccggggttctgctactacacaggatgaagaaaggaaacgggattatgaaggttatttatgctccctgctgctccctgcagaatcccgaagctctgtttttgcactgagggcctttaatgtggaactggctcaggctggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcattgatgttaattctagtctattagttttataaaagttaggattcttatttaggaacaacaggaaatgactgttaaggagaaaatgaatttattgaatgggatgtcaagtagctcacaaaattgagaagttgccgtgggactagggtgccaagactgctgagattctggcagaggcactgccattggcacccctggcccagacagtgtctgctgtgctgtccctggaagctggagctccaacagggaatattggtgtagctgtgcataggccataagccacacttgagccagtgggcagggagaaggaatgtcattctcccttcaccactggggaaggaaaggggaaagggctcaagttatcataggggcttacatgctgagcagctataacctaggtgttcagaacacctggaagatgcatttatttaggggtcacaaatagtgaaattaatatttgaggaatatcagtcacgtgttgtgggcttttatccttaacgtttaatttttacaatcttgtgtaaaaatttatccatgataataacataacttctttaaggttggagtggctggcaagagcagagccttaatttgactttagctctggctggtctggaagcttttacttttttgttaatcccacttcctcactctgtcattcagcattatcatgatcgtgaacaaaattgtactgagaaagtttgtataagtgatatgaacggtattgtattgaacatccattaaagggttgctacacttta

SEQ ID NO: 157632 - DNA, 1798 bp, Homo sapiens
  Payload ID: 10893
  Gene Symbol: NDUFAF6
  Gene Name: NADH dehydrogenase (ubiquinone) complex I, assembly factor 6
  Uniprot ID: Q330K2
  ENST ID: ENST00000396124
  CDS Start-End: 24-1025
gaagggcacgcagtgccggcgtcatggcggcctccgcgcacggctctgtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggcattgatgttaattctagtctattagttttataaaagttaggattcttatttaggaacaacaggaaatgactgttaaggagaaaatgaatttattgaatgggatgtcaagtagctcacaaaattgagaagttgccgtgggactagggtgccaagactgctgagattctggcagaggcactgccattggcacccctggcccagacagtgtctgctgtgctgtccctggaagctggagctccaacagggaatattggtgtagctgtgcataggccataagccacacttgagccagtgggcagggagaaggaatgtcattctcccttcaccactggggaaggaaaggggaaagggctcaagttatcataggggcttacatgctgagcagctataacctaggtgttcagaacacctggaagatgcatttatttaggggtcacaaatagtgaaattaatatttgaggaatatcagtcacgtgttgtgggcttttatccttaacgtttaatttttacaatcttgtgtaaaaatttatccatgataataacataacttctttaaggttggagtggctggcaagagcagagccttaatttgactttagctctggctggtctggaagcttttacttttttgttaatcccacttcctcactctgtcattcagcattatcatgatcgtgaacaaaattgtactgagaaagtttgtataagtgatatgaacggtattgtattgaacatccattaaagggttgctacacttta

SEQ ID NO: 157633 - DNA, 946 bp, Homo sapiens
  Payload ID: 10893
  Gene Symbol: NDUFAF6
  Gene Name: NADH dehydrogenase (ubiquinone) complex I, assembly factor 6
  ENST ID: ENST00000454358
  CDS Start-End: 1-247
gtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatatta

SEQ ID NO: 157634 - DNA, 949 bp, Homo sapiens
  Payload ID: 10893
  Gene Symbol: NDUFAF6
  Gene Name: NADH dehydrogenase (ubiquinone) complex I, assembly factor 6
  ENST ID: ENST00000523378
  CDS Start-End: 549-949
agcacaacgtggagtggctgcagaatgtaaacaccactcagccacgcgcctggccaagtgcggctctgctctccccagtcccggtccgcgaccacccggagcccgctccgccggccttgcgcggcgcgcccagggaaggcatttccagcccgcccacccaggtctcttcttcggcctttctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggcagccacctctcaacaacccatgaagtgtctggagctccaccctctgctcaagaggaacggcacatgacccaggcctatgccaatcagcatttcacattcctcatggttggttcaaaggaaacgggattatgaaggttatttatgctccctgctgctccctgcagaatcccgaagctctgtttttgcactgagggcctttaatgtggaactggctcaggctggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcag

SEQ ID NO: 157635 - DNA, 561 bp, Homo sapiens
  Payload ID: 10893
  Gene Symbol: NDUFAF6
  Gene Name: NADH dehydrogenase (ubiquinone) complex I, assembly factor 6
  ENST ID: ENST00000518608
  CDS Start-End: 1-175
gtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagaagtctcactcttgtcgcccaggctggagtacaatggcacgaccttggctcactacaacctccacctcccgggttcaagtgattctcctgcctcagcttcccgagtagctgggattacaggaaaaaaatctggatgacaaagcatatcgtaatatcaaggaactggaaaattatgctgaaaacacacagagctctcttctttacttaacactagaaatattgggtataaaggatcttcatgcag

SEQ ID NO: 157636 - DNA, 845 bp, Homo sapiens
  Payload ID: 10893
  Gene Symbol: NDUFAF6
  Gene Name: NADH dehydrogenase (ubiquinone) complex I, assembly factor 6
  ENST ID: ENST00000520632
  CDS Start-End: 1-282
gtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctggttaaagactcagtctctgagaaaacaattggactgatgcgaatgcagttttggaaaaaaactgtggaagatatatactgtgacaatccaccacatcagcctgtggccattgaactatggaaggtctgcacaccagcagaggcaggcccagtttctgggccccagattgacttcacagagccccagtaaagatggaaagccagaaccccccaactggggattgagaagaaaaagtggatgggaagctgctgttaaaagacataatctgactaaaagatggcttatgaaaatcgtcgatgaaagaagtctcactcttgtcgcccaggctggagtacaatggcacgaccttggctcactacaacctccacctcccgggttcaagtgattctcctgcctcagcttcccgagtagctgggattacaggaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattg

SEQ ID NO: 157637 - DNA, 1373 bp, Homo sapiens
  Payload ID: 10893
  Gene Symbol: NDUFAF6
  Gene Name: NADH dehydrogenase (ubiquinone) complex I, assembly factor 6
  Uniprot ID: Q330K2
  ENST ID: ENST00000518258
  CDS Start-End: 16-381
cgcagtgccggcgtcatggcggcctccgcgcacggctctgtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctggattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggttgtcccagctttggacagcggaaactccttcacagcggctgctatgtccttgtgacacgcttccgtcattttttggagcactttcttattttctgacacaataagatattctaggatccttttgaatctctcccctgcctcacctttggaatcgcccatttctcgagagccctgattcctttaaggagaatggtagtagagacaagtgtctgggcactaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttcatggca

SEQ ID NO: 157638 - DNA, 796 bp, Homo sapiens
  Payload ID: 10893
  Gene Symbol: NDUFAF6
  Gene Name: NADH dehydrogenase (ubiquinone) complex I, assembly factor 6
  Uniprot ID: Q330K2
  ENST ID: ENST00000523337
  CDS Start-End: 4-369
gtcatggcggcctccgcgcacggctctgtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctggattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggag

SEQ ID NO: 157639 - DNA, 816 bp, Homo sapiens
  Payload ID: 10893
  Gene Symbol: NDUFAF6
  Gene Name: NADH dehydrogenase (ubiquinone) complex I, assembly factor 6
  ENST ID: ENST00000519136
  CDS Start-End: 532-816
ctccccagtcccggtccgcgaccacccggagcccgctccgccggccttgcgcggcgcgcccagggaaggcatttccagcccgcccacccaggtctcttcttcggcctttctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggaaacgggattatgaaggttatttatgctccctgctgctccctgcagaatcccgaagctctgtttttgcactgagggcctttaatgtggaactggctcaggctggattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcat

SEQ ID NO: 157640 - DNA, 1196 bp, Homo sapiens
  Payload ID: 10893
  Gene Symbol: NDUFAF6
  Gene Name: NADH dehydrogenase (ubiquinone) complex I, assembly factor 6
  ENST ID: ENST00000517976
  CDS Start-End: 1-294
gcgcacggctctgtctgggggccgttgcggcttggcatccccggcctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctggttaaagactcagtctctgagaaaacaattggactgatgcgaatgcagttttggaaaaaaactgtggaagatatatactgtgacaatccaccacatcagcctgtggccattgaactatggaagtgattgccaaaagagggtttctgtaacaggagccacccacagacctgacagtggtacacctcttctcaggtctgcacaccagcagaggcaggcccagtttctgggccccagattgacttcacagagccccagtaaagatggaaagccagaaccccccaactggggattgagaagaaaaagtggatgggaagctgctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggtttctctagaggactttctaaagaaaattcagcgagtggattttgatatattccacccatctttacagcagaagaatacattacttccattatatttgtatattcagtcatggagaaaaacatattaaaataatttc

SEQ ID NO: 157641 - DNA, 419 bp, Homo sapiens
  Payload ID: 10893
  Gene Symbol: NDUFAF6
  Gene Name: NADH dehydrogenase (ubiquinone) complex I, assembly factor 6
  ENST ID: ENST00000519804
  CDS Start-End: 112-419
cgtaatattacctaagtggtctgtgtcctcttcagagtcagaaggaggcatgaaatatccgtctgactcccagcagttaaagactcagtctctgagaaaacaattggactgatgcgaatgcagttttggaaaaaaactgtggaagatatatactgtgacaatccaccacatcagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgt

SEQ ID NO: 157642 - DNA, 1474 bp, Homo sapiens
  Payload ID: 10893
  Gene Symbol: NDUFAF6
  Gene Name: NADH dehydrogenase (ubiquinone) complex I, assembly factor 6
  ENST ID: ENST00000520757
  CDS Start-End: 1-427
gtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggttaaagactcagtctctgagaaaacaattggactgatgcgaatgcagttttggaaaaaaactgtggaagatatatactgtgacaatccaccacatcagcctgtggccattgaactatggaaggtctgcacaccagcagaggcaggcccagtttctgggccccagattgacttcacagagccccagtaaagatggaaagccagaaccccccaactggggattgagaagaaaaagtggatgggaagctgctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcagaagaaaggtgttccttcccatggatatttgtatgctgcatggtgtttcacaagaggactttctacggaggaaccaagataaaaatgtgagagatgtaatatatgacattgccagtcaagcacacttgcacctaaagcatgctaggtcctttcacaaaactgttcctgtgaaagcatttcctgcttttcttcagacggaaattaaggatgcagacactcagggcgtgtgtcttgcacagccagccagcctgggaaaatgaagccaactgggagagagatttgaaggactctggttctaggcatgcgcacttctccaggtacttgagcttggaaaccttcttgcttaactagctctaggccaatcttgcttcactcgaacacgcacacacttctccttgcgctattttgaattaccagaggagaatctttgacaaacacaggtcgatgttagtgtgagccagactgggcaactacacaaaatcaaaatcaggaaaggagagccactttgctggaatctcccagaaggctggtggggtggactccggggctttgaaatctctaaagagtggtgactcacctctcctagaaattgccctggttatatcataaaagggctcaatttttacatgaggtctcaatggtctttttacttaatgtgacatcattagaaaaatcaacctttgaccagaaagaggcagttccctccttcctcacacaattcacaattttctgg

SEQ ID NO: 157643 - DNA, 582 bp, Homo sapiens
  Payload ID: 10893
  Gene Symbol: NDUFAF6
  Gene Name: NADH dehydrogenase (ubiquinone) complex I, assembly factor 6
  ENST ID: ENST00000522683
  CDS Start-End: 1-309
ctgtgctgccgccggccgcctctgggtctgtacgcgcgcatgcggcggctgcccgggccggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctggattactcttgctgctgtcttgctgtactgtatgccactgggatctgaacactaaacattgctaagaaacccacccaccaccaggatatttggaagtaacttcacatatggaaaagttaaagactcagtctctgagaaaacaattggactgatgcgaatgcagttttggaaaaaaactgtggaagatatatactgtgacaatccaccacatcagcctgtggccattgaactatggaagtgattgccaaaagagggtttctgtaacaggagccacccacagacctgacagtggtacacctcttctcaggtctgcacaccagcagaggcaggcccagttt

SEQ ID NO: 157644 - DNA, 2176 bp, Homo sapiens
  Payload ID: 10894
  Gene Symbol: NDUFAF7
  Gene Name: NADH dehydrogenase (ubiquinone) complex I, assembly factor 7
  Uniprot ID: Q7L592
  ENST ID: ENST00000002125
  CDS Start-End: 41-1366
cccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaacgaa

SEQ ID NO: 157645 - DNA, 1869 bp, Homo sapiens
  Payload ID: 10894
  Gene Symbol: NDUFAF7
  Gene Name: NADH dehydrogenase (ubiquinone) complex I, assembly factor 7
  Uniprot ID: Q7L592
  ENST ID: ENST00000336237
  CDS Start-End: 28-1059
ggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaaggttcttttagataaatcaaatgagccatcagtgaggcagcagttacttcaaggatatgatatgttaatgaatccaaagaagatgggagagagatttaacttttttgccttgctacctcatcagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcaggaggctgagacaggagaatcacttgaacctgggaggtggaggttgcggtgagctgagatcgtgccactgcactccagcctgggcaacaagagcaaaaatccctctcaaaaaaaaaagtaaacatgggcactgattgttttaataaaaatgggaaacagactaaatggctattcacaggaaactgataagatatatgttatttttttaaatgagctagggcaatatgttttgacagaaaactctctaagatttagtaagtgaaaaaaagtaggatgcaagagtttttatagttgattccatttttgttgaaggagaaaaactaaataaatacgagtaatttcatagaaacgaa

SEQ ID NO: 157646 - DNA, 934 bp, Homo sapiens
  Payload ID: 10894
  Gene Symbol: NDUFAF7
  Gene Name: NADH dehydrogenase (ubiquinone) complex I, assembly factor 7
  ENST ID: ENST00000439218
  CDS Start-End: 132-934
agctcttcagttgagggtaccgggggatcaagggctcgggggctcacttccaccttgaagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagatac

SEQ ID NO: 157647 - DNA, 783 bp, Homo sapiens
  Payload ID: 10894
  Gene Symbol: NDUFAF7
  Gene Name: NADH dehydrogenase (ubiquinone) complex I, assembly factor 7
  ENST ID: ENST00000431821
  CDS Start-End: 94-783
agcctgcgaatttcagcatgagtgtactgctgaggtcaggtttggggccgttgtgtgccgtggcgcgcgcagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcactaagtctgggattccaatttcctggtaccgagatctgcacgatgttccaaaagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagat

SEQ ID NO: 157648 - DNA, 663 bp, Homo sapiens
  Payload ID: 10894
  Gene Symbol: NDUFAF7
  Gene Name: NADH dehydrogenase (ubiquinone) complex I, assembly factor 7
  ENST ID: ENST00000432075
  CDS Start-End: 220-663
ggggatcaagggctcgggggctcacttccaccttgaaggtaccctgggctggaaacgggtccggtacaaacgcaatagggctgcgtagtcgtgggcaagtgggtgctgtctctgcgccccgtgggcgtgctaagcacagtagcccgcgccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacatctggtagaggtaagccaaaaattaagtgagattcaagcattgacactgactaaagagaaggtcccgttagagcgaaatgctggatccccagtgtatatgaaaggtgtcact

SEQ ID NO: 157649 - DNA, 473 bp, Homo sapiens
  Payload ID: 10894
  Gene Symbol: NDUFAF7
  Gene Name: NADH dehydrogenase (ubiquinone) complex I, assembly factor 7
  ENST ID: ENST00000416653
  CDS Start-End: 141-473
gtcagtcccctcgaagcccggttgccgtggaagccgcgtggggcgccttcctcagctcttcagttgaggccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtaggggaaccctcgtgggagatattttgagggtgttcactcaacttggatctgtgctgaaaaattgtgacatttcagtacat

SEQ ID NO: 157650 - DNA, 661 bp, Homo sapiens
  Payload ID: 10894
  Gene Symbol: NDUFAF7
  Gene Name: NADH dehydrogenase (ubiquinone) complex I, assembly factor 7
  ENST ID: ENST00000441905
  CDS Start-End: 1-267
gggttttgcgaccacaagcttcatgatgtcttaattgccccaggaacagcagatctaacagctgatgtggacttcagttatttgcgaagaatggcacagggaaaagtagcctctctgggcccaataaaacaacacacatttttaaaaaatatgggtattgatgtccggctgaagagacttcaaggtggaagatatcagaggaatgcacgtcagtcaaaaccctttgcatccgttgtagctgggtttagtgaacttgcttggcagtgatatttcagcttggacattttacccttcagtcggcccaagaaatcaaaataaaggaaacacatttcatatactgcagcactgcagatgacaatctacaaagaacaagttacacagcaaaatatcagtccataaaatgaaatccttccttatttaggttagctcagtgattaaggatcttcttccatatcatctggattaggagccataatgaagtgctttgggtatacaaggttatgtgtgtatgcatgtatttcccagcgagcatcatcactttcatgtgtaatgtaacgttctccaatgcgagtttcaaattctctaaggtcaagccaagtctgatagtcctaggagaaaatgaaattgtaatgatgaaacaaaagaaacaaaatactgtcaa

SEQ ID NO: 157651 - DNA, 946 bp, Homo sapiens
  Payload ID: 10894
  Gene Symbol: NDUFAF7
  Gene Name: NADH dehydrogenase (ubiquinone) complex I, assembly factor 7
  ENST ID: ENST00000455230
  CDS Start-End: 76-489
gtcggggcgtgtcttctcccggaaatggtctaagccccagctcctggcggagcgagctagcctgcgaatttcagcatgagtgtactgctgaggtcaggtttggggccgttgtgtgccgtggcgcgcgcagccattccttttatttggagagggaaatacttcagctccgggaatgagcctgcagaaaacccggtgacgccgatgctgcggcatcttatgtacaaaataaagtctactggtcccatcactgtggccgagtacatgaaggaggtgttgactaatccagccaagggttattatgtgtaccgtgacatgctaggcgaaaaaggagatttcattacttcacctgaaataagtcaaatctttggggagctactaggtatatggttcattagtgaatggatggccactggaaaaagcacagctttccagctggtggaactgggcccaggtgttcactcaacttggatctgtgctgaaaaattgtgacatttcagtacatctggtagagggtacagcttttatcttgcacatgaattttttgatgttcttcctgtgcataaatttcagaaaacaccacagggatggcgagaagtatttgttgacattgatccacaggtttctgataaactgaggtttgttttggcaccttctgccaccccagcagaagccttcatacaacatgacgaaacaagggatcatgttgaagtgtgtcctgatgctggtgttatcatcgaggaactttctcaacgcattgcattaactggaggtgctgcactggttgctgattatggtcatgatggaacaaagacagataccttcagagggttttgcgaccacaagcttcatgatgtcttaattgccccaggaacagcagatctaacagctgatgtggacttcagttatttgcgaagaatggcacagggaaaagtagcctctctgggcc

SEQ ID NO: 157652 - DNA, 11819 bp, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENST ID: ENST00000233190
  CDS Start-End: 268-2451
cacttccggcggaactgcgggtccaagttgtccttcccgcctccgggctgggccgacctcagctccgccctctggtcggctgacggaaattgccgacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaatggctaatgataatttagctttattatatgtgctaagcactctggttttacatgcattatcttcttttgttcttgctacaaccctgtgagatagtagtattatctcattttactgatgaagactgaagcctaggtatattaaatagcttgcccaaggccacacagcaaaagtcaccaactcaaacctacttcttatttactccaaagcctgttgttcttaactgcaacatattatttcgtctcattaatgttgattctataggttgttacttctaaaaattagtattgagtttaatggtgaacacatttttctattttctcttgaatctgcttctataatgtcatggtgatttatgtggcttttttttttttataagttatacatgtatgcatgtatacttatgagacctcccttggaatgagggaggtctcaagagatataatttagattctcattgatgttctgtattcattatcctaacaccatctgtagtgttaaatcaactaaattatttcagcaataggagacaaaacaaccagctttcataatttttaattgtcaaaaccaaaaggaatcagaataaggatcactgagaatttaaaaaaataaaaaaggaagtaaaaattttacaattaggagataattaaaaatagataatttttttttttaatctaaggttgggtgtggtggcttacacctgtaatcccaacacttggggggccaaggtgggtggatcgcttgagcccaggcagttggagaccagtctgggcaacatggtgaaaccccatctctacaaaaaatacaaaaattagctgggtgtggtggtgtacacctatagtcccagctactcggaaggctgaggtgggaggatcacctgacccaggaggttgaggctgcagtgagccgtgattgcgccactgcattccagcctgggcaacagagcaagactttgtttcaaacaaacaaacaaaactatgttcacaatttatttgttttgtaatccttattcttttctgctttcactaaagactcagcccaagtataggatgccctttttccctttgttttttttttttttttgagatggagtcttactctgtcacccaaggctggaatgcagtggcatgatcttggctcactgcaatcaccacctccctgattcaagcgattctcctgcctcagcctccccggtagctgggattacaagcgcacgccaccacacctggctaatttttgtatttttagtagagacagggtttcaccaatttggccaggctggtcttgaactcctaacctcaggtgatctacctgccttggcctcccaaagtgctgggattacaggcgtgagccaccgcgcccagtctaggatgtcgtttttctgatacaacaaaggataaggttttagaataatagtatgttacaatatctttaaaaacagcaggtgcagtggctcacacctgtaagcccagcattttgggggttcaaggcaggaagatcagttgaggccaggagttcaagaccagcctggactgcatagcaagatcctatttgtacaaaaaaatgtaaaacttaaaattgcacaaaatttgtcacctgtaccagcttttagaactgtttatcttatcctcctcagtgatacatcatgaagttgtgtgctttgcctaaaatgcccagttacctgaaattgtataaattcttgccaaaagtgtttgaacttaatacaaacttcccatctcttacctcttagcactgtgctcatcttgaggggacatagtcccaattttgtattttatataatactgttaatgaatatgtgtagacttcatatggttgtgggtaagagaatactgcattcagatagaaaagatgctatatagctaagttgatccaggatccttgggctacctgctaggcagcttgtggtgaacaatcataatctctaaaaaataccttgtctggaccgggcgcggtggctcacacctgtaatcccagcactttggcaggctgaggcgggcagatcattgaggtcaggagtttgagaccagcctggccaacgtggtgaaaccctgtctctactaaaaatacaaaaattagccaggcatggtggcacatggctgtaatcccagctactggggaggctgaagcaggaaaatcgcttgaactgagagtcaaggcggaggtcgcggtaagccgagatcacaccattgcactgcagcctgggtgaagaaacaagcctccctctcaaaaaataaataaataaataaataatacctcctctgggataagtagtgctccgtctgtctcatgggcacatattagtgtcgtaatgccaaatactaaggttattgtaagcataaacattgaagataattgctagagaaaaatagactgaaaaagatgtaagaaaaatacacgtagatgagagtaacctgtctggtggaatcatgacattctaagcagtgaaggaatcaccaatgagaaaatctacaaaggctcaagatcaagtctctttaggtgaataaggcaatctagaaagaccttggaataataataccatttcctgaggaccttctaaataagtgccattaaagctttaaatacattaagactattcttcacaaaatctctgctaatagtaggtattaattgagactcaagaaatatcaaataacttatttatggctacacagctagatactaatggcaggagtgtttaattagaagtacttttactatcccaggttgcctcaaatgaaaacattttggacagcaatgtaaggtgaatagctgagcatgatggcacaagctatagccccagctacttgggaggctgaggcacaaggattgcttgagcaaatgagttgagtccagcatggacaactgtattcctgcagcctgcttgtattcctctcctcaaagtgctttttccttctctgccacatgactagtctgtgaattttccaaacttctacgctctgcttcccttttaaatatgttccaactttaagttatttctttgcttccatatctgattgtaggctgctagcatcagccaggccacatcttgaatgctttgctgcttagaaatttcttctgccagataccctgataccctaagtcatcactcttaagttcaaacttccacagattcctagggcctggacacaatgcacccaagctatttgctaaagcatgacatagatgtacctttattcctgttcccaataacttcctcatttccatctgagacctcatcactctggacttcaccatatgtctatcagcattttggtcacaaccacttaactagtctctaagttccaaactttccctcatctttctgtcttctgagccctccagattcttccaacctctgcctgttacccagttccaaagctgtttctacattttccaatatgtatagcagtgccccactgtcagtactaatctgttttaatctgtttgcattactgtaaaggaatatctgagattgggtaattcttgcaaaagagagatttaattggcttacagtttctgcaggctgtacacaaagcatggcaccagcagctgcttctgatgagggcctcaggaagcttacaatcatggtagaaggcaaaatgggagcgagcatatcacatggtgagagagggagcaagagagaggaggaggtcccagactctaaacaaccaaatttcacatgaactaagatctcactcatcaccaaggtgatggtgccaagccattcatgaaggatttgccccatgattctatacctcccacgaggccctacctccagcattgggggttacatttcaacatgagatttggaagtgacagccatccaaaccatatcagcaacataacaagacccccaactcttaaaaaaaaaagttgaatatatatccaaaaatatcttgaattccatatggaaagcctcccccctcaaatttgtagtaaattgtattataatgaatacattaattaaaaatatacttggcctggcacagtagctcaagcctgtaatcccagcactttgggaggccgaggcaggcggatcacctgaggtcaggagttttcgagaccagcctgtccgacatggtgaaactctgtctctactaaaaatacaaaattagccagccatggtggcatatgcctgtaatcccagctactcactcaggaggctgaggcaggagaatcacttaaacccaggagacggaggttgcagtgagtcaagattgcaccgttgcactccagcctgggtgacagagtgagactctgtctgaaaaaaagtaaaaattaaaaaatatatttgacaatacccagtaccaatttattgtttgttgttgacattaacattttctttaagagtatttcttcatctgtaaaatgaggataaaaattgtaaaattgtacctacttccagcctcatagaattgttttgatgattacatcagaaagcttgtaaaaaccttaggcctgtttcctgacatatactaaatgccccatgtgctaactgaggatgatcattgtaggaaaatttcatagactatgagggaaagccatgcctaaaataatctccagcttattaagaagtgcattcctttttgtttctttgttttatcttagattgagtctcactgtattgccagtctggagtgcagtggcgcaatctcagctcactgcaacctccacctcctgggttcaagcgatcctcctgcctcagcctcctgagtagctgggactacaggagcacaccaccacgcccagctaatttttgtgtttttagtagaggcggggtttcaccatgttgggcaggatggtctcaaactcctgacctcaggtgatccacccgcctcaacctcccagagtgctgggattacaggcgtgagctatccgtgcccagtcaatttttgtatttttagtagagatgaggtttcaccatattggtcaggctggtcttgaacccctgacctcaggtgattcacccgcctcagcctcccaaagtgctgggattccagatgtgagccagcgcacccagcctggccatcttttataaaaagatgaagatgtcagaattccctaataagattctggctctgttacccagactggagtgcaatgcatggcatgatctcagcacactgcaacctccatctcctgggctcaagccatcctcccacttcagtctcccaagtggctgggactacaggcacacgccaccacacctggctaatttttgtattttttgtagagacgaggtttcgccatgttacccaggctggtcttaaactcctgagttcaagtgatccacctgcctcagcctcccaaagtgctgggattacaggcatgagccactgtacccggcccctaataagttttaaataaccaatattttaaaatattttaatagttacatagcactttagtttgctgatttaatttatcccaagggacaaggatgttaatgagaaaactgactagatttcagatcacagattttaagagaacaaggatctcaaaaccaaataccctctgcttaaagtgttttttgtgtttttcactactgaaaatgtttagagattgacttacctattgctgatactcaaaacatctgatatcttaatatttttaaataactcactaaaagcatatgttgaaaatggcaatgtatagtctgagactggtgattagactggactaaaagcatatgttggaaatggcaaatatatgatctgagactggtgattaatttacagtattggcacctaaagagatactgagatgaataacttattaatttccttcttaaaatcataattttggatctgtaaaggactatacaaaaaaaaattttagtattatacctgcattttataattgtggaaatggaggccagaaagaataagaggcaagttaggggcagatcttgggtttggatcagctcttctgatgcctggttctgtgacattacaaagcctgaaattcagctccaacatctattaaacatttgcagagtatcagctgggtgcggtggctctcataaggccaggagttcaagaccagcctggccaagatagtgaaaccccatctctactaaaaatacaaaaattagccgggcatggtggcaagacacctgtaatcccagctactctggaggctgagtcagagaattgcttaaacctgggaggcggaggttgcagtgatcccagatcgcgccactgcgctctagcatgggcgacaaagcgagaccccatctcaaaaagaaaaacaaaatttttttgcagagtatctactgtgtgtcaagtacattacccaagactacaaagagaaatacaatttagctaatgtcctcaagaagctaacagtatactaaaagagatatgtaggcatcaattatagtaatgacataacatattctaatagaggtaagtacataacacagtgggcatgtctagttgtctttgtttctgctgttaaaacagaatatcacagactgggtgatgggttgattgattgactgattgaggcaactctgtcacccaggctggggttcagtggcatgatcacagttcactgcagcctcaacctccctggatcaagcaatcctcctgcctcagcctcctgaacagctggaactacaggtgtgagccaccatgccccactaatttttatttatttattttttttttctgagacggagtctcagtttgtcgcccaggctgaagtgcagtggcacaatctcagctcactgcaacctccacctcccgggttcagttttcctgcctcaatctactaggatctagctaggattacaggtgtgcgccaccatgcccagctaatttttgtatttttagtagagacggggtttcaccatgttggtcaggctggtctcaaactcctgacctcatgatctgcccacctcggcctcccaaagtgctgggattacaggcgtaagccaccgcgcccagctaatttttaaaaatattttatagagacaggtctcactatgttgcccaggctcgtcttgaacccctgggcccaggcgctcctcccaccttgacctcccaaagttctggaattacacatgtgagccaacacaccaggcccagactgggtaatttataaagaaatttacttctgcccacaccgccccgcctccccgcgcgagtggctgaggcgtagcgctgccatccccgcacccctgggaacatggcgctgcgagtggtgcggagcgtgcgggccgtgctctgcagcctgcacgtggtcctggcacctgccgcgccctgcctatcgaggccctggcagcttgggatgggcgccgtctggttactgtaatctgcctgaagttgggacaaaattgaacaaacaagatgagtttggtgctttggagagtgtgaaagctgctagtgaactctattctcctttatcaggagaagtaaccgaaattaatgaagctcttgcagaaaatccaggacttgtaaacaaatctcgttatgaagatggttggctgatcaagatgacactgagtaacccttcataactagatgaacttatgagtgaagaagcatatgagaaatacataaaatctattgaggagtgaaaatggaaccactaaataagctagtatgaaataacgcaacccagcagagttgtcctaaattagtggtggatagaagacttagaatagcaacttttagcattacccatgggaaaaaaaaactactgttaacactgctaatgaaagaagatgccttttaactttctaatgattgtagataaacataatatgtgtctttttcacaacatcctatgatttttagactaggctctagtattcatgaaattatccatgaaattatccatggtaaaaattagttacaaaaattacataattcaaagataatgttgttattcttaagccttatataatattgtaacttgtgtatgtccatacctggacttgggatgaaatacttaatgatctttccattggaaataactgggagtgaagaagtttttgttgcttgtacagtgtcagatgaagaacaacactatcttaattttgcaatacactgcatttgctggtgctgtttttatatagtgaagcaacagctgtacagcaaaataataaaatactcacttcttcgttaaaaaaaaaaaaaatttacttcttacaattctggaggccaggaagaccatgatcaggtgccagcatctgggaagggccttcttgctgtcctcccatggcagaagatggaagggcaagggagagctaacatgctcccgcaaaccctttttataatggcatcaatcaaatatgaggccagagtccttgtgacctaatcatctcccagaaggctccgcctcccaaccctgttgcattgggattaagtttccaacacatgaattgtggagacaacacattcaaaacatagcattccacaccttgggctccccagattcatgtcctcacatgcaaaataaattcattccatcccaatagcccctaaaaagtcttaacttgttccagcatcaactttaaagtcaaagtccaaagtctcatctaaatcagatatgagtgagactcaaggcatgattcatcatgagacaaaggatgtacatttgcaatgtttgtcatgtcagacaaaacaaaaatatgtaaatatccatcaatagggaactgctgaaaaatttttttgtataatcataaaatgaaacatgcagatgtttaaaccaatgagctagatctcaacgtgctgatatggaaagtgcttcagaatgtattaaggacataaattaagtgtacaataatgtgtgtgtgtgtatatatgtatatgcttacgtgtgtatggaaagtatctcagcagatacaataaaaacttaattgtgatta

SEQ ID NO: 157653 - DNA, 569 bp, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  ENST ID: ENST00000454195
  CDS Start-End: 179-569
gacgtagtcttctgttgtccttgactgggcgccgcctcccgccccgccgcctcggaagcccctgagagccggcagatggggggcttttagccacggtctctggtctgatgaagcagaaaagaagatgaggatcagggggtcctcgggaacgctgtcacgaatgtaggcttgcagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctattt

SEQ ID NO: 157654 - DNA, 3361 bp, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENST ID: ENST00000455934
  CDS Start-End: 62-2287
gagagccggcagatggggggcttttagccacggtctctggtctgatgaagcagaaaagaagatgaggatcagggggtcctcgggaacgctgtcacgaatcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgctaaagaaaagatttaagcaccttgtcaagctgggtaaataggaaaaatacataatcatgctcagatatgtatctaggataattataattaataataatcatagtaacaatggctaatgataatttagctttattatatgtgctaagcactctggttttacatgcattatcttcttttgttcttgctacaaccctgtgagatagtagtattatctcattttactgatgaagactgaagcctaggtatattaaatagcttgcccaaggccacacagcaaaagtcaccaactcaaacctacttcttatttactccaaagcctgttgttcttaactgcaacatattatttcgtctcattaatgttgattctataggttgttacttctaaaaattagtattgagtttaatggtgaacacatttttctattttctcttgaatctgcttctataatgtcatggtgatttatgtggcttttttttttttataagttatacatgtatgcatgtatacttatgagacctcccttggaatgagggaggtctcaagagatataatttagattctcattgatgttctgtattcattatcctaacaccatctgtagtgttaaatcaactaaattatttcagcaataggagacaaaacaaccagctttcataatttttaattgtcaaaaccaaaaggaatcagaataaggatcactgagaattt

SEQ ID NO: 157655 - DNA, 563 bp, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  ENST ID: ENST00000456284
  CDS Start-End: 90-365
atattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggtacttgatacctaaaattctacaccatgctgtagaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgt

SEQ ID NO: 157656 - DNA, 2631 bp, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENST ID: ENST00000423725
  CDS Start-End: 253-2265
gacaaacttgtcgaatgcaaggattctagtccctccgggctttccgttctccaggcccggctgacagagttagccgaggccgccatattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtggcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgataacctttgtgacgaacataaagagatccttaaattatgagttgttggcttatcttcataaataatttgtctgtaaaatggatgaaatgaaaagaggttcaattaaaacctacttttttctagtgct

SEQ ID NO: 157657 - DNA, 2371 bp, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENST ID: ENST00000449699
  CDS Start-End: 104-2287
gagagccggcagatggggggcttttagccacggtctctggtctgatgaagcagaaaagaagatgaggatcagggggtcctcgggaacgctgtcacgaatcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagcttgtgagaaggttggcatgcagatccctcgattctgttatcatgaaaggttgtctgttgctggaaactgcaggatgtgccttgttgaaattgagaaagcccctaaggttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgt

SEQ ID NO: 157658 - DNA, 2171 bp, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  ENST ID: ENST00000457011
  CDS Start-End: 96-1931
atattgaataagcgacccggcctcctagggggtcgtcgtggtccagacagtttagcagaacagcctccgcggctccggggagaagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctcttaaaagcattgat

SEQ ID NO: 157659 - DNA, 2080 bp, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENST ID: ENST00000432169
  CDS Start-End: 146-1996
atattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgt

SEQ ID NO: 157660 - DNA, 2394 bp, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENST ID: ENST00000440274
  CDS Start-End: 90-2165
atattgaataagcgacccggcctcctagggggtcgtcgtggtccagacagtttagcagaacagcctccgcggctccggggagaagcaatatgttaaggatacctgtaagaaaggccttagtaggcctttctaagtctcctaaaggatgtgttcgaacaactgccacagcagcaagcaacttgattgaagtatttgttgatggtcagtctgtcatggtggaaccgggaacgaccgtcctccaagttgtagctgcttgtgccatgccagtaatgaagggttggaatatcctaacaaactcagaaaaatccaaaaaagccagggaaggtgtgatggagttcttattagcaaatcacccattggactgtcctatttgtgaccagggaggtgaatgtgatctgcaggaccagtccatgatgtttggaaatgataggagccgatttttagaggggaagcgtgctgtggaagacaagaacattgggccattggtaaagaccatcatgacaagatgtatacagtgtactcgctgcatcaggtttgcaagtgagattgcaggagtagatgatttgggaacaacaggcagaggaaatgatatgcaagttggcacatacattgaaaagatgttcatgtctgaactgtctgggaatatcattgatatctgccctgtaggtgccctaacctctaagccctatgcctttactgcccggccttgggaaacaagaaagacagaatccattgatgtaatggatgcggttggaagtaatattgtggttagcacaagaactggagaagtgatgaggattttgccacgtatgcatgaggacatcaatgaagagtggatctctgataaaaccagatttgcctatgatgggctaaaacgtcaaagacttaccgagccaatggtcagaaatgaaaaagggcttttaacctatacttcttgggaggatgcgctctctcgcgtagctggaatgttgcagagttttcaaggcaaagatgtggcagcaattgcaggtggcttggtggatgctgaagccctggtagctctcaaagatttgcttaatagagtggactctgacaccttatgcactgaagaggtcttccccactgcaggagctggcacagatttgcgttccaattatcttcttaatactacaattgctggtgtggaagaggcagatgttgttcttctggttggtacaaacccacgttttgaggcaccactgtttaatgctagaattcgaaagagctggctgcataatgacttaaaagtggcccttataggcagtccagtggacctcacttacacatatgaccacctgggagactcccccaaaattcttcaagacattgcttcgggaagccatccatttagccaggtcctaaaggaagctaaaaaaccaatggtggttttaggcagttctgcactccaaagaaatgatggagcagcaattcttgcagctgtttctagcattgcacaaaagattcggatgactagtggtgttactggtgattggaaagttatgaatatccttcataggattgcaagtcaagtagctgctttggaccttggctataagcctggggtggaagcaattcggaagaaccctcccaaggtgctgtttctcctgggagcagatggaggttgtatcacacgacaggatttgccaaaggattgtttcattatttatcaaggacatcatggtgatgttggggctcccatagctgatgttattctcccaggagctgcttacacagagaagtctgctacatatgtcaacactgagggtagagctcagcagactaaggtagcagtgacacctcctggcttggcaagagaagactggaaaattataagagcactctctgagattgctggaatgactcttccatatgatactctggatcaagtaaggaacagattggaagaagtctctcctaatcttgttcgatatgatgatattgaaggggctaattacttccagcaagcaaatgagctctcaaagctagtgaaccagcagcttcttgctgacccacttgttccacctcagctaactataaaagacttctacatgacagattcaattagcagagcctcacagacaatggccaaatgtgtcaaagctgtcacagagggtgcccaggcagtagaggaaccatccatatgctgaagcttctactaggatcccagttttgccgcagataattaatggacaactgtagtgcagtgatcctttacaggtttatttctttgtaaaaaaaaataataataatttgaatcatgtaatatttaaggttatactatgcctatttgaaaatgatattagttatcaactttgcagtttgaaaaacatgtattgtgtgtaaaggttaaataacaaaactatgcagatgctctta

SEQ ID NO: 157661 - DNA, 2042 bp, Homo sapiens
  Payload ID: 10896
  Gene Symbol: NDUFS2
  Gene Name: NADH dehydrogenase (ubiquinone) Fe-S protein 2, 49kDa (NADH-coenzyme Q reductase)
  Uniprot ID: O75306
  ENST ID: ENST00000367993
  CDS Start-End: 449-1840
gccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacagaaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtatgttcatgtacacttggctgtcaggctttctgtgcatgtactaaaaaaggagaaattataataaattagccgtcttgcggcccctaggcctaaa

SEQ ID NO: 157662 - DNA, 2064 bp, Homo sapiens
  Payload ID: 10896
  Gene Symbol: NDUFS2
  Gene Name: NADH dehydrogenase (ubiquinone) Fe-S protein 2, 49kDa (NADH-coenzyme Q reductase)
  Uniprot ID: O75306
  ENST ID: ENST00000392179
  CDS Start-End: 240-1613
aaaagccagccaggagctgtgggaggaaacgccctcagtaaagatgaccgcggtcactgttatctaaacgcaagtgaagccgagtcacaggacccggatgttgtcagttcgacggtaaacgaccctgccagcttccaagagggcggcttcactgtgcgaataggtgagaagccaagaaggaggcgcgctggagttacttccgcccggttctccttcccgcagtctgcagccggagtaagatggcggcgctgagggctttgtgcggcttccggggcgtcgcggcccaggtgctgcggcctggggctggagtccgattgccgattcagcccagcagaggtgttcggcagtggcagccagatgtggaatgggcacagcagtttgggggagctgttatgtacccaagcaaagaaacagcccactggaagcctccaccttggaatgatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggcccttccatactttgaccggctagactatgtgtccatgatgtgtaacgaacaggcctattctctagctgtggagaagttgctaaacatccggcctcctcctcgggcacagtggatccgagtgctgtttggagaaatcacacgtttgttgaaccacatcatggctgtgaccacacatgccctggaccttggggccatgacccctttcttctggctgtttgaagaaagggagaagatgtttgagttctacgagcgagtgtctggagcccgaatgcatgctgcttatatccggccaggaggagtgcaccaggacctaccccttgggcttatggatgacatttatcagttttctaagaacttctctcttcggcttgatgagttggaggagttgctgaccaacaataggatctggcgaaatcggacaattgacattggggttgtaacagcagaagaagcacttaactatggttttagtggagtgatgcttcggggctcaggcatccagtgggacctgcggaagacccagccctatgatgtttacgaccaggttgagtttgatgttcctgttggttctcgaggggactgctatgataggtacctgtgccgggtggaggagatgcgccagtccctgagaattatcgcacagtgtctaaacaagatgcctcctggggagatcaaggttgatgatgccaaagtgtctccacctaagcgagcagagatgaagacttccatggagtcactgattcatcactttaagttgtatactgagggctaccaagttcctccaggagccacatatactgccattgaggctcccaagggagagtttggggtgtacctggtgtctgatggcagcagccgcccttatcgatgcaagatcaaggctcctggttttgcccatctggctggtttggacaagatgtctaagggacacatgttggcagatgtcgttgccatcataggtacgaggcctattgtgtagtagaggtatcctagacaaaggagttcgggacgcccactggggacagaaggagaacacttcctgttcaccataggccatggcatggactcgggtcctcaatcttttgagcacagtaatgggttctggatcttgggtaacaccactttttttgtttgttttgcctcacaacaggaagataagtaacatcacttttttcctccatcctctcacctaggtacccaagatattgtatttggagaagtagatcggtgagcaggggagcagcgtttgatcccccctgcctatcagcttcttctgtggagcctgttcctcactggaaattggcctctgtgtgtgtgtgtgtgtgtgtgtgtgtgtgtatgttcatgtacacttggctgtcaggctttctgtgcatgtactaaaaaaggagaaattataataaattagccgtcttgcggcccctaggcct

SEQ ID NO: 157663 - DNA, 958 bp, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  Uniprot ID: O75489
  ENST ID: ENST00000263774
  CDS Start-End: 83-877
acacttccgtttccggtccgtgcccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagattgtctacaacctgttgtctctgcgcttcaactcacggatccgtgtgaagacctacacagatgagctgacgcccattgagtctgctgtctctgtgttcaaggcagccaactggtatgaaagggagatctgggacatgtttggagtcttctttgctaaccaccctgatctaagaaggatcctgacagattatggcttcgagggacatcctttccggaaagactttcctctatctggctatgttgagttacgttatgatgatgaagtgaagcgggtggtggcagagccggtggagttggcccaagagttccgcaaatttgacctgaacagcccctgggaggctttcccagtctatcgccaacccccggagagtctcaagcttgaagccggagacaagaagcctgatgccaagtagctccagggaacgcatgtggatcctagacagcgccttatctatgattgagtgtccgtgtaaataaattcctacttagactta

SEQ ID NO: 157664 - DNA, 253 bp, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  ENST ID: ENST00000530295
  CDS Start-End: 21-253
ctagtctgcatctgagtaacatggcggcggcggcggtagccaggctgtggtggcgcgggatcttgggggcctcggcgctgaccagggccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcct

SEQ ID NO: 157665 - DNA, 561 bp, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  ENST ID: ENST00000528192
  CDS Start-End: 53-538
gctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgagacggaatcttgctctgtcgccaggctggagtgcagtggcatgatcttggctcactgcaacctccgtctcccaggttcaagcgattcccctgcctcagccccttgagtagctgggactacaggtgcatg

SEQ ID NO: 157666 - DNA, 583 bp, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  ENST ID: ENST00000534208
  CDS Start-End: 21-386
ctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtaatacttactaatgttatttgggtctgggtcaagaaagaaccatgttcgcagggcatgtgggagtgggcagacttgtttcaaagaaactacagattcctccatcccaagcttggacttttctctcagcattaaaccaggtgactccagctgaagttagctgttccctcagtagctctttgttccctctcccctcactttcatgtgtgcaggtgtcctgcttcaatgagttagaggtctgtatccatcctgatggcgtcatcccagtgctgactttcctcagggatcacaccaatgcacagttcaaatctctggttgacttgacagcagtg

SEQ ID NO: 157667 - DNA, 558 bp, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  ENST ID: ENST00000529276
  CDS Start-End: 64-267
gtgcccttggggctccgtgtcctgctgtctttccgtccgctgcctagtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccgtgagtatgtgcgggcagcgctcttctctgaactatcggcggggccccttagatgcctgtccttgccctaggatgcccttccctacgtcctcctggcaaatcttggagatctgacttgcagtggtcttcaccctgcatgcagaatcgagccctccctgtgcccttaggcctgttatggccctgattgttccttgtccatttcaatcatcccctttttgtctgattaaactgtcagctctttgaaagcaagcaatataacctttaggcctcagagccctgtaataatagtacctagcgttaattgagtgcttaatgtgtgcctggaacctcgctaagcgttttagtgaatgatcttatttcgt

SEQ ID NO: 157668 - DNA, 1263 bp, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  Uniprot ID: O75489
  ENST ID: ENST00000534716
  CDS Start-End: 19-417
agtctgcatctgagtaacatggcggcggcggcggtagccaggctgtggtggcgcgggatcttgggggcctcggcgctgaccagggggactgggcgaccctccgttctgttgctgccggtgaggcgggagagcgccggggccgacacgcgccccactgtcagaccacggaatgatgtggcccacaagcagctctcagcttttggagagtatgtggctgaaatcttgcccaagtatgtccaacaagttcaggtgtcctgcttcaatgagttagaggtctgtatccatcctgatggcgtcatcccagtgctgactttcctcagggatcacaccaatgcacagttcaaatctctggttgacttgacagcagtggacgtcccaactcggcaaaaccgttttgaggtcagttgggagatctgagaaggttttgggggtaaggatattaatttcagtttgtaacatacaatagaacacagcagttaaactggaacttcagagtcaagtagatctgaagttggatcttggttctgccactaaatggctgtgggacctcagataactcaaatattttgtttaattttttttttttttagacggaatcttgctctgtcgccaggctggagtgcagtggcatgatcttggctcactgcaacctccgtctcccaggttcaagcgattcccctgcctcagccccttgagtagctgggactacaggtgcatgccaccacgcccggctaattttttgtatttttttagtgaagactgggtttcaccatgttggccaggatggtctcaatttcctgacctcgtgatctgcctgccttggcctcccaaagtgctgggattacaggcatgagccaccatgcccggcccttgtttaatctttctgagctttcattttcttaccgggaaaataaatataaagctgtccttatcttatagaatggttataaggatccaatgagatagttcaagtaaattgcttgcacacagtgttttcaatacatttagctattaatattttactgattatctactgtttgccagactctgggatggagagagaaataacatgaagtatttgtcctccaggagtcccctacactctagtgaaggagaaagacacctaaacagcttactgtagtaacatataatacaaaggatattagagggatgctttaagaaagcaggaggggcacttggccctgtctgggaggcttctttgaaaagagagaatgtttgtgctgaatctaaaatatgagtagg

SEQ ID NO: 157669 - DNA, 675 bp, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  Uniprot ID: O43181
  ENST ID: ENST00000296684
  CDS Start-End: 29-556
tttcatcctggcgtttgcctgcagcaagatggcggcggtgtcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctgtgcagtatttatagtccatgtataataaatacatctcttaatctcctaataaattggacctttaaactacaga

SEQ ID NO: 157670 - DNA, 562 bp, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  ENST ID: ENST00000502423
  CDS Start-End: 29-250
tttcatcctggcgtttgcctgcagcaagatggcggcggtgtcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggcatttggagttcctgttcactctacctggatgcattttaactaatcctgaggacttcatccggtcaccatctacctattcttcaaatggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaag

SEQ ID NO: 157671 - DNA, 559 bp, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  ENST ID: ENST00000506765
  CDS Start-End: 1-351
tcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacgatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctgtgcagtatttatagtccatgtataataaatacatctcttaatctcctaataaattggacctttaaactaca

SEQ ID NO: 157672 - DNA, 680 bp, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  ENST ID: ENST00000507026
  CDS Start-End: 31-180
cctttcatcctggcgtttgcctgcagcaagatggcggcggtgtcaatgtcagtggtactgaggcagacgttgtggcggagaagggcagtggctgtagctgccctttccgtttccagggttccgaccagagacagggccttgctctgtcatccaggctggagtgcagtggtgcaatcatagctcactacatccctgagctcctgggcttaagcagtcctcccacctcagcctcccaggcagctgcgactataggtcgttgaggacttccacatggagattggcacaggaccagactcaagacacacaactcataacagttgatgaaaaattggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaat

SEQ ID NO: 157673 - DNA, 833 bp, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  ENST ID: ENST00000506974
  CDS Start-End: 17-412
gtttgcctgcagcaagatggcggcggtgtcaatgtcagtggtactgaggcagacgttgtggcggagaagggcagtggctgtagctgccctttccgtttccagggttccgaccaggtcgttgaggacttccacatggagattggcacaggaccagactcaagacacacaactcataacagttgatgaaaaattggtttatcttgtaccactgtgttttacattctgtggtctagccacaccaagcctggaacttgctactctttttcctgcttcaaggcatttggagttcctgttcactctacctggatgcattttaactaatcctgaggacttcatccggtcaccatctacctattcttcaaatggatatcactactttaactggagttccagaagagcatataaaaactagaaaagtcaggatctttgttcctgctcgcaataacatgcagtctggagtaaacaacacaaagaaatggaagatggagtttgataccagagagcgatgggaaaatcctttgatgggttgggcatcaacggctgatcccttatccaacatggttctaaccttcagtactaaagaagatgcagtttcctttgcagaaaaaaatggatggagctatgacattgaagagaggaaggttccaaaacccaagtccaagtcttatggtgcaaacttttcttggaacaaaagaacaagagtatccacaaaataggttggcactgactatatctctgcttgactgtgaataaagtcagctgtgcagtatttatagtccatgtataataaatacatctcttaatctcctaataaattggacctttaaactaca

SEQ ID NO: 157674 - DNA, 544 bp, Homo sapiens
  Payload ID: 10899
  Gene Symbol: NDUFS5
  Gene Name: NADH dehydrogenase (ubiquinone) Fe-S protein 5, 15kDa (NADH-coenzyme Q reductase)
  Uniprot ID: O43920
  ENST ID: ENST00000372967
  CDS Start-End: 84-404
atcctttacggcaggcgtccgcgtcgctagctagtcgttctgaagcggcggccagagaagagtcaagggcacgagcatcggccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctatttgttctattttctcttgga

SEQ ID NO: 157675 - DNA, 548 bp, Homo sapiens
  Payload ID: 10899
  Gene Symbol: NDUFS5
  Gene Name: NADH dehydrogenase (ubiquinone) Fe-S protein 5, 15kDa (NADH-coenzyme Q reductase)
  Uniprot ID: O43920
  ENST ID: ENST00000372969
  CDS Start-End: 88-408
atcctttacggcaggcgtccgcgtcgctagctagtcgttctgaagcggcggccagagaagagtcaagggcacgagcatcgggtagccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacgatgagacgtgcaggtaccatcaggaagcagcgggataagctgataaaggaaggaaagtacacccctccacctcaccacattggcaagggggagcctcggccctgaacagagcagctgctgatgtctggaggctgattttcctgttctctgttctccactggaaaggttgtttacgacaaacctccttgtcaaagtgtgtaaaaataaaggattgctccatcctatttgttctattttctcttgga

SEQ ID NO: 157676 - DNA, 1082 bp, Homo sapiens
  Payload ID: 10900
  Gene Symbol: NDUFS6
  Gene Name: NADH dehydrogenase (ubiquinone) Fe-S protein 6, 13kDa (NADH-coenzyme Q reductase)
  Uniprot ID: O75380
  ENST ID: ENST00000274137
  CDS Start-End: 19-393
aaaggccagcggcgcaaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggacaaagaaacaaaaaccggcacatgcggttactgtgggctccagttcagacagcaccaccactagagcgtgtggcacgccgggggtcccgcagcatcctgtgagcatttccgcggggaagctgagcacgtgaagctcgctggttctgtgcgaagggtattcctggtgctgaataaagggtgttgctgtcaaggctgacaatttgtaagtttgtttctttcatagtctgggctttggaagtgaacatccacgtggacatgggtagacatgcgagtggaagcagtgcccgctccagtgagcctgagctgcctcctgccggccgctgcctgccttaccggctgcttctgtgtgtctcctcttatccttggggccacgtgggctgcaggaatgggcggggggcagggaaggagaaggagaagtgcctcttgttttgcagatgcaactgtgcttcagagagccaaggtgggtcttgaggtgcatagtgaaggagggtgcccaggcctcaactggtcctatgggaaggtcagcctctctcctgttgctggcttgcagagctggtctatccgtccgtcctagtccctatgttgaaatgtcagatcttaaaacccaagaatttaagcactggtttgaaggcatcgaaagtcacatactggccacattaaggacagtctatgtttttaaaagagtaaggattataatgtagtgtaacataaaaataaaagtagattttgagggaagagaaaggagtcttgcta

SEQ ID NO: 157677 - DNA, 550 bp, Homo sapiens
  Payload ID: 10900
  Gene Symbol: NDUFS6
  Gene Name: NADH dehydrogenase (ubiquinone) Fe-S protein 6, 13kDa (NADH-coenzyme Q reductase)
  ENST ID: ENST00000469176
  CDS Start-End: 4-522
aaaatggcggcggcgatgaccttctgccggctgctgaaccggtgtggcgaggcggcgcggagcctgcccctgggcgccaggtgtttcggggtgcgggtctcgccgaccggggagaaggtcacgcacactggccaggtttatgatgataaagactacaggagaattcggtttgtaggtcgtcagaaagaggtgaatgaaaactttgccattgatttgatagcagagcagcccgtgagcgaggtggagactcgggtgatagcgtgcgatggcggcgggggagctcttggccacccaaaagtgtatataaacttggtgcgtagctggccacctgtgcacatgttagggcagcctgctcgtcctcatactccccttcactcccagtgcctgttctttctgtcctcttctctacctgctcccgaggcggcccttacggggttcacactgctggcacattcaccctacagcgccacactacagggcctacatagagccgcctgtccgaaaaccccctttcaactgtgaagtggtgggcggcatgtttctcttctcg

SEQ ID NO: 157678 - DNA, 1039 bp, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  Uniprot ID: O75251
  ENST ID: ENST00000233627
  CDS Start-End: 297-938
gggacgcgtggtgacttttgccctcctggaataacaagaaaatgagtgtcgcctctgtttttgtcggtccgccgcagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcctccca

SEQ ID NO: 157679 - DNA, 2818 bp, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  Uniprot ID: O75251
  ENST ID: ENST00000313408
  CDS Start-End: 24-644
gttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgcccacgagggagctggagacagggccagcgccacacggagcccggcggcccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagcaggggaagctgagtggaattcctgacacacgcctggtttacagcagtttcatatggtcctacctggcacaaaccaaagacctgcagttagaaataccaagcgagaaggttcctgggggccaaggacactgtcccgcgccctcagccttacagaagggcacgcaggactccctgggacccggggtggccggatttggcaaatgaaaacgtgggaggcttagtttgactgtgaggttagggtgaatttgaccatcaggaaaactgttagtagtaattgtttagtacgagtatatcccaacaatatttgggctatactgacactaaaaagagcattggctgcatacctgaaattcacatcgcaccgggaacattctttatatctggtgatcccgtgggactcttgcacctcacgtggtcccacgagggccatccccccgggcgttcaccttgacagtggtccacggtaggcaggcttggaggtggcgctcatgtgggacaggggacagagtcctgttcttggccaccctgtgctgcgtgcggcattagctcatgcgcagagagcccagccctgagtcccgagtctgggggtttgggcaagcgagaggcacatcctggtgcctctcaaaagtggaggaacaggctctgactttggattccgcttccctggaaagggcgttgatttgttcagcgttctgcacggttcaggtcaccccgggggcagtggagagggcagcctgggcctccctgtgacttgacagcacagagaggtccatcctggggtcaggagctctgcccatgcccctggcgtcttcccctgcagtgcagaccaatggggcaagttgcgagtgtggactgtactcctccctccttgcagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtcctttctcacctgtttccactcctgctgtccccgttgggccctgggcttcgtcctcttgctcaagccctttgttctgaacctgcgtggcagccgggactgggggatccccagcaaagagctctggcttggggctcagaaagagggtcatcgggtcctcgtgggatgcccgggctctgggccacctcccctccctccgcccagcctccctgcctccatctccgtccagggcagccccgggccctgctccccactgctaagtgtgtctgctgagcgctggcccccattgagtcctgagggctggggccgggggccgggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgcc

SEQ ID NO: 157680 - DNA, 841 bp, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENST ID: ENST00000414651
  CDS Start-End: 6-716
ccaagatggcggtgctgtcagctcctggcctgcgcggcttccggatccttggtctgcgctccagcgtgggcccggctgtgcaggcacgaggtgtccatcagagcgtggccaccgatggcccaagcaggcctctggcagcggccgtgggggctcgcatccgcctctgggaagcacctgcgtggctgacgcctcctgtgcccgtgtgtctctgtgccagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgcccacgagggagctggagacagggccagcgccacacggagcccggcggcccctgtgagggagtcccacacccccagcagacggcgggctcccccatcctatggatgggccgactcggagcgctgcctcttagtggagcctgtcccctgtgagaagtcggcgatgtattcaggcatcagaggg

SEQ ID NO: 157681 - DNA, 1060 bp, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  Uniprot ID: O75251
  ENST ID: ENST00000546283
  CDS Start-End: 302-922
tttgtaaggtctcccagggcgccggagcgcagtgtcgtctctgtggcgcaatcggttagcgcgttcggctgttaaccgaaagacccgcggcccccacgtgcgcactccgatgacctttccgcctcgggtgatctgggggtgcacggcgcaacacgaccacggaggccgaaagcgcagcggaacctcccggctccaggttccggtttccgcatgcgctccgagccgctttgggcggcggccccgggaacccggagcgctaaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggtagggccgggaccgcaccgcccacgagggagctggagacagggccagcgccacacggagcccggcggcccctgtgagggagtcccacacccccagcagacggcgggctcccccatcctatggatgggccgactcggagcgctgcctcttagtggagcctgtcccctgtgagaagtcggcgatgtattcaggcatcagagggatcagagggagca

SEQ ID NO: 157682 - DNA, 745 bp, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENST ID: ENST00000534853
  CDS Start-End: 21-221
gtctgaaggccgaggccaagatggcggtgctctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcggg

SEQ ID NO: 157683 - DNA, 1743 bp, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENST ID: ENST00000539480
  CDS Start-End: 28-576
agaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccagactgagctcctccctccctggggaccgcgctcctccctccctgcggactgtgctccctgtctggggactgcgctcctccctccttggggaccgtgctcctccctccctccctgcggaccgcgctcctccctccctggggaccgcgctcctccctccctgcggaccgcgctcggccctccctggggaccgcgcccctccctcccagcggaccgcgctcctccctccctggggacctcgctcctccctccctccctgcggactgtgctgctccctccctgcggactgtgcttctccctcccttggagcagcctggacttgccagagctctgccaggtggggcctggccgccctttcccaggccctgcagtggccttgtcctttctcacctgtttccactcctgctgtccccgttgggccctgggcttcgtcctcttgctcaagccctttgttctgaacctgcgtggcagccgggactgggggatccccagcaaagagctctggcttggggctcagaaagagggtcatcgggtcctcgtgggatgcccgggctctgggccacctcccctccctccgcccagcctccctgcctccatctccgtccagggcagccccgggccctgctccccactgctaagtgtgtctgctgagcgctggcccccattgagtcctgagggctggggccgggggccgggttagtgaggtcagcgtcttgtccgagaggtccctgtgacagcccgggatgagccacgggtggagggcagtggggccttgcccaggggaggaccccactcttcctgcagggacctcccctgcgccggctcccagtccctggcactgcgcccacccagggctgtcagcctccaccttcagaggccggcccgggaaacccttccaaagccgagccggctgcgctgtgcacgcggtcacgcgggctccggctgcgggaagcgagactgaggcaaggtccctgcaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcctccca

SEQ ID NO: 157684 - DNA, 869 bp, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENST ID: ENST00000546172
  CDS Start-End: 10-135
gaggccaagatggcggtgctgtcagatggagtctccctctgtcacccaagctggagtgcagtggcgcagcctctgctcactgcaacctctacctcccgggttcaagtgattctcctgcctcagcctctcgagtagctgggattacagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcc

SEQ ID NO: 157685 - DNA, 688 bp, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENST ID: ENST00000618074
  CDS Start-End: 44-688
aaggagaacggacctcagaggttgtctgaaggccgaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaagccgcccagccgcccccagaatgccggagccgcgctacgtggtctccatggggagctgcgccaacggaggaggctactaccactattcctactcggtggtgaggggctgcgaccgcatcgtgcccgtggacatctacatcccaggctgcccaccgccgaggccctgctctacggcatcctgcagctgcagaggaagatcaagcgggagcggaggctgcagatctggtaccgcaggtag

SEQ ID NO: 157686 - DNA, 754 bp, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENST ID: ENST00000620479
  CDS Start-End: 10-654
gaggccaagatggcggtgctgtcagctcctggcctgcgcggcttccggatccttggtctgcgctccagcgtgggcccggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaagtcttccctacgaccagatgccggagccgcgctacgtggtctccatggggagctgcgccaacggaggaggctactaccactattcctactcggtggtgaggggctgcgaccgcatcgtgcccgtggacatctacatcccaggctgcccaccacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcctccc

SEQ ID NO: 157687 - DNA, 791 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  Uniprot ID: O00217
  ENST ID: ENST00000313468
  CDS Start-End: 108-740
acagaaaagggggaacccgctggcccaatggcagcgtcctacagtgtagcctccgcctcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 157688 - DNA, 620 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENST ID: ENST00000453471
  CDS Start-End: 248-620
ctacagtgtagcctccgcctcccgattgactggcctgcttggcaaggcaagtagcggcggcgcttcaagggacggggttccaccatgttagccaggctggtctcaaactcctgacctcaggtgatccacctgcctcagcctcccaaagtgctgggattacaggcgtgagccaccacacccagccctagcgagtcactcaacaaactgagtcccagcgccttatttgtgcctccctcgtggagtccttatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccagg

SEQ ID NO: 157689 - DNA, 606 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENST ID: ENST00000529645
  CDS Start-End: 1-123
ctgaccacgcctatgctgctgcgggccctggcccaggctgcacgtgcaggacctcctggtggccggagcctccacagcagtgcagtggcagccacctacagtgagtacctgggtggcctctagcctcaggtgttcctgactggtcctgctggagtaggggaagagacctgagttccagtcctggctttgtcaggggcgttcttctctgagcctgtttccacttttaaaatgattatggtgatggagactgactctgattcacaggggcagggtccatcattgccgagagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccagggtgagacccttagggcagcgggtgctacactgaacaaagcggtgaacagccccct

SEQ ID NO: 157690 - DNA, 353 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENST ID: ENST00000528492
  CDS Start-End: 113-307
gattgactggcctgcttggcaaggcaagtagcggcggcgcttcaaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccga

SEQ ID NO: 157691 - DNA, 515 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENST ID: ENST00000525628
  CDS Start-End: 186-515
ggaaggtgctgggttgggtccctggaactgcagtcagtgatccaaaggagtgggcctgttagggggttcacaggtcgtgggatgagctcttatgagcgccggctaagtgccgggctctggggtgcccttggcatgtacgggctcccctaattcccaagaccaaccgcccccaacccacttcatagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgt

SEQ ID NO: 157692 - DNA, 531 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENST ID: ENST00000531228
  CDS Start-End: 165-377
cacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcaggtgcagcggggagccggctctcagggcgcatgcgccgcccgctctgcgccaccggcctagttagggtcggagatcactgggaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtac

SEQ ID NO: 157693 - DNA, 561 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENST ID: ENST00000525419
  CDS Start-End: 148-561
agtcgggcttgggcagcgtggcgtcgggggcgagtgtggtgtccccgttggcgccgccagctctgcgcctgggcttcccctcggctcactcaggatccgcggcctccgtgtccttcaggtgcagcggggagccggctctcagggcgcatgcgccgcccgctctgcgccaccggcctagttagggtcggagatcactgggaagagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgc

SEQ ID NO: 157694 - DNA, 814 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENST ID: ENST00000526446
  CDS Start-End: 51-182
tcccgattgactggcctgcttggcaaggcaagtagcggcggcgcttcaagatgcgctgcctgaccacgcctatgctgctgcgggccctggcccaggctgcacgtgcaggacctcctggtggccggagcctccacagcagtgcagtggcagccacctacagtgagtacctgggtggcctctagcctcaggtgttcctgactggtcctgctggagtaggggaagagacctgagttccagtcctggctttgtcaggggcgttcttctctgagcctgtttccacttttaaaatgattatggtgatggagactgactctgattcacaggggcagggtccatcattgccgagagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacgggg

SEQ ID NO: 157695 - DNA, 616 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENST ID: ENST00000524810
  CDS Start-End: 1-281
gggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccagggtgagacccttagggcagcgggtgctacactgaacaaagcggtgaacagccccctcgtgagagggggttcttggcagatgacgccagcagctgacaaacaggcaaggcaggccgggcacggtggctcacgcttgtaatcccagcactttgggagtccaaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaaggagaagttgctcaacaacggggacaagtgggaggccgagatcgccgccaacatccaggctgactacttgtatcggtgacgccccaccggcccgcagcccctgctgcccaataaaaccactccgacccca

SEQ ID NO: 157696 - DNA, 689 bp, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENST ID: ENST00000526339
  CDS Start-End: 136-689
cacgttttggccgtgaaagtcgggcttgggcagcgtggcgtcgggggcgagtgtggtgtccccgttggcgccgccagctctgcgcctgggcttcccctcggctcactcaggatccgcggcctccgtgtccttcagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgagccaagagctgatggcagccgccggaccacccgctatgacatcgacatgaccaagtgcatctactgcggcttctgccaggaggcctgtcccgtggatgccatcgtcgagggccccaactttgagttctccacggagacccatgaggagctgctgtacaacaa

SEQ ID NO: 157697 - DNA, 1596 bp, Homo sapiens
  Payload ID: 10903
  Gene Symbol: NDUFV1
  Gene Name: NADH dehydrogenase (ubiquinone) flavoprotein 1, 51kDa
  Uniprot ID: P49821
  ENST ID: ENST00000322776
  CDS Start-End: 154-1548
gaagttgaaggggcgcagcgataccggtgcgcggcgctggcgtcgggcgcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctgg

SEQ ID NO: 157698 - DNA, 1512 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000415352
  CDS Start-End: 62-1435
agttcctcagcctcagtgctatgaaggtgacagcgtgaggtgacccatctggcccgccgcgatgctggcaacacggcggctgctcggctggtcgcttcccgcgcgggtatctacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 157699 - DNA, 620 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000532343
  CDS Start-End: 334-620
agttcctcagcctcagtgctatgaaggtgacagcgtgaggtgacccatctggcccgccgcgatgctggcaacacggcggctgctcggctggtcgcttcccgcgcggcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgt

SEQ ID NO: 157700 - DNA, 1493 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000532303
  CDS Start-End: 326-1417
gcgtgacgtctttcctgcgcgccacctagcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcc

SEQ ID NO: 157701 - DNA, 679 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000527355
  CDS Start-End: 1-384
tgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgcccaccctcca

SEQ ID NO: 157702 - DNA, 582 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000529867
  CDS Start-End: 48-582
agtgctatgaaggtgacagcgtgaggtgacccatctggcccgccgcgatgctggcaacacggcggctgctcggctggtcgcttcccgcgcgggtatctgtgcgtttcagcggcgacacggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggct

SEQ ID NO: 157703 - DNA, 544 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000530103
  CDS Start-End: 48-179
agtgctatgaaggtgacagcgtgaggtgacccatctggcccgccgcgatgctggcaacacggcggctgctcggctggtcgcttcccgcgcgggtatctgtgcgtttcagcggcgacacgtcctcggcctggcggaagttttgcagacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctac

SEQ ID NO: 157704 - DNA, 559 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000528314
  CDS Start-End: 402-559
aaaaaaaaaaaaatgcttactaagtggcagtggtatctatgatgctatagatgcttccctagccctagcccagcccctcctaaatagggagacccaagattctgtagcttctggcccaatccctcatggccccagagcactctgggcctcctgaccctttgtctccctagacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgc

SEQ ID NO: 157705 - DNA, 774 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000533919
  CDS Start-End: 1-402
gaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagca

SEQ ID NO: 157706 - DNA, 786 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000532244
  CDS Start-End: 378-786
agcgtctctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggtaaggcctggc

SEQ ID NO: 157707 - DNA, 1503 bp, Homo sapiens
  Payload ID: 10903
  Gene Symbol: NDUFV1
  Gene Name: NADH dehydrogenase (ubiquinone) flavoprotein 1, 51kDa
  Uniprot ID: P49821
  ENST ID: ENST00000529927
  CDS Start-End: 66-1433
cgccagttcctcagcctcagtgctatgaaggtgacagcgtgaggtgacccatctggcccgccgcgatgctggcaacacggcggctgctcggctggtcgcttcccgcgcggacagcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatgcttgtggctctggctatgattttgacgtgtttgtggtgcgcggggctggggcctacatctgtggagaggagacagcgctcatcgagtccattgagggcaagcagggcaagccccgcctgaagccccccttccccgcagacgtgggagtgtttggctgccccacaactgtggccaacgtggagacagtggcagtgtcccccacaatctgccgccgtggaggtacctggtttgctggctttggcagagaacgcaactcaggcaccaaactattcaacatctctggccatgtcaaccacccttgcactgtggaggaggagatgtctgtgcccttgaaagaactgattgagaagcatgctgggggtgtcacgggcggctgggacaacctccttgctgtgatccctggcggctcgtctaccccactgatccccaagtctgtgtgtgagacggtgctgatggacttcgatgcgctggtgcaggcacagacaggcctgggcacagctgcggtgatcgtcatggaccgctcgacggacatcgtgaaagccatcgcccgcctcattgagttctataagcacgagagctgtggccagtgtaccccatgccgtgagggtgtggactggatgaacaaggtgatggcacgtttcgtgaggggggatgcccggccggccgagatcgactccctgtgggagatcagcaagcagatagaaggccatacgatttgtgctctgggtgacggggccgcctggcctgtgcagggtctgatccgccactttcggccggagctcgaggagcggatgcagcggtttgcccagcagcatcaggcccggcaggctgcctcttagcccaccaccctggcctgctgtcctgcgtctatccatgtggaatgctggacaataaagcgagtgctgccca

SEQ ID NO: 157708 - DNA, 477 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000528328
  CDS Start-End: 251-477
tctatcgcgccagttcctcagcctcagtgctatgaaggtgacagcgtgaggtgacccatctggcccgccgcgatgctggcaacacggcggctgctcggctggtcgcttcccgcgcgggtatctgtgcgtttcagcggcgacacgccttgtagggcgtgaaggggtcattgccccatttagggatgcgcacctcctgatttcccgtccactgctctgcgccctgaagtggctgaaaagtgctcttaaaaggatgggaatcccgtcgccctcagctgcacccaagaaaacctcatttggctcgctgaaggatgaagaccggattttcaccaacctgtacggccgccatgactggaggctgaaaggttccctgagtcgaggtgactggtacaagacaaaggagatcctgctgaaggggcccgactggatcctgggcgagatcaagacatcgggtttgaggggccgtggaggcgctggctt

SEQ ID NO: 157709 - DNA, 582 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000530638
  CDS Start-End: 150-582
gctatgaaggtgacagcgtgaggtgacccatctggcccgccgcgatgctggcaacacggcggctgctcggctggtcgcttcccgcgcgggtatctgtgcgtttcagcggcgacacgcacccaagaaaacctcatttggctcgctgaaggatgaagaccggattttcaccaacctgtacggccgccatgactggaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggca

SEQ ID NO: 157710 - DNA, 582 bp, Homo sapiens
  Payload ID: 10903
  Gene Symbol: NDUFV1
  Gene Name: NADH dehydrogenase (ubiquinone) flavoprotein 1, 51kDa
  ENST ID: ENST00000533075
  CDS Start-End: 48-582
agtgctatgaaggtgacagcgtgaggtgacccatctggcccgccgcgatgctggcaacacggcggctgctcggctggtcgcttcccgcgcgggtatctgtgcgtttcagcggcgacacgacagcacccaagaaaacctcatttggctcgctgaaggatgaagaccggattttcaccaacctgctgaaaggttccctgagtcgaggtgactggtacaagacaaaggagatcctgctgaaggggcccgactggatcctgggcgagatcaagacatcgggtttgaggggccgtggaggcgctggcttccccactggcctcaagtggagcttcatgaataagccctcagatggcaggcccaagtatctggtggtgaacgcagacgagggggagccgggcacctgcaaggaccgggagatcttacgccatgatcctcacaagctgctggaaggctgcctggtggggggccgggccatgggcgcccgcgctgcctatatctacatccgaggggaattctacaatgaggcctccaatctgcaggtggccatccgagaggcctatgaggcaggtctgattggcaagaatg

SEQ ID NO: 157711 - DNA, 930 bp, Homo sapiens
  Payload ID: 10904
  Gene Symbol: NDUFV2
  Gene Name: NADH dehydrogenase (ubiquinone) flavoprotein 2, 24kDa
  Uniprot ID: P19404
  ENST ID: ENST00000318388
  CDS Start-End: 115-864
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactggggaagacatgtaaggaatttgcataagacagttatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacgtaaactta

SEQ ID NO: 157712 - DNA, 942 bp, Homo sapiens
  Payload ID: 10904
  Gene Symbol: NDUFV2
  Gene Name: NADH dehydrogenase (ubiquinone) flavoprotein 2, 24kDa
  ENST ID: ENST00000400033
  CDS Start-End: 118-876
caaggtgcataagatttttcctgaaggtaatactaacagattgggcatggggtccgagggtattctaggtggaaaggacaacttaaagtcttgttggcaagaaaaagatcggtatgtatgagaagccaccctctgctgttggagaccttacagacaatttgtttctacaaaaatggaaagggaagacatgtaaggaatttgcataagacagttatgcaaaatggagctggaggagctttatttgtgcacagagatactcctgagaataaccctgatactccatttgatttcacaccagaaaactataagaggatagaggcaattgtaaaaaactatccagaaggccataaagcagcagctgttcttccagtcctggatttagcccaaaggcagaatgggtggttgcccatctctgctatgaacaaggttgcagaagttttacaagtacctccaatgagagtatatgaagtagcaactttttatacaatgtataatcgaaagccagttggaaagtatcacattcaggtctgcactactacaccctgcatgcttcgaaactctgacagcatactggaggccattcagaaaaagcttggaataaaggttggggagactacacctgacaaacttttcactcttatagaagtggaatgtttaggggcctgtgtgaacgcaccaatggttcaaataaatgacaattactatgaggatttgacagctaaggatattgaagaaattattgatgagctcaaggctggcaaaatcccaaaaccagggccaaggagtggacgcttctcttgtgagccagctggaggtcttacctctttgactgaaccacccaagggacctggatttggtgtacaagcaggcctttaatttatattgaactgtaaatatgtcactagagaaataaaatatggacttccaatctacgtaaactta

SEQ ID NO: 157713 - DNA, 854 bp, Homo sapiens
  Payload ID: 10904
  Gene Symbol: NDUFV2
  Gene Name: NADH dehydrogenase (ubiquinone) flavoprotein 2, 24kDa
  ENST ID: ENST00000577703
  CDS Start-End: 115-234
gcgtgccgtccgggtcgcctaggcctggggtcgggagcgcgcacgctgtgcgccctgggcgcgctcgggattctcgcctggcgcggctggggaaggtgaacagtgtggcccgccatgttcttctccgcggcgctccgggcccgggcggctggcctcaccgcccactgggtaaggaggctcaagctgagcccggcgctgccgccgcccttctcttgctctccgtgtctcccttagttttgggcgcaggagagccctgggctctgcacgggcctgcaggcggcggcaaggacactgcggccttagccctcttagggaggccgctgcagccccaccgtgagaagccccgagggagggttgccatactgggaagtgtactcctagtttggtcgaggaggacagaaaagaggggctgcttggtgatatatatatatatgtttgtttgtttttgctgttttgctgtagcgcagaatctaggcctgctctggccagatcagtttcgaagaccgtcgctccgaaggaggcacctctcgtttcaagcctagtgacctcgatgcttttaggttgcagcatactggagagctctggcttgcttcgtgaaggcttagggagaacttcattagggctggaaaagggtggccaatgtttgatttactgcagttgtgctttgcatatcggaaatgctggctaaataaacggtatcaaactaactctgaaagaacggcgccgcaaataacagcacccaattaaagaaccacaggattttagagattaaatgatctttttgagatccaagtacatctcatgggaagacatgtaaggaatttgcataagacagttatgcaaaatggagctgg

SEQ ID NO: 157714 - DNA, 868 bp, Homo sapiens
  Payload ID: 10904
  Gene Symbol: NDUFV2
  Gene Name: NADH dehydrogenase (ubiquinone) flavoprotein 2, 24kDa
  ENST ID: ENST00000497577
  CDS Start-End: 50-115
cgggattctcgcctggcgcggctggggaaggtgaacagtgtggcccgccatgttcttctccgcggcgctccgggcccgggcggctggcctcaccgcccactggcgcagaatctaggcctgctctggccagatcagtttcgaagaccgtcgctccgaaggaggcacctctcgtttcaagcctagtgacctcgatgcttttaggttgcagcatactggagagctctggcttgcttcgtgaaggcttagggagaacttcattagggctggaaaagggtggccaatgtttgatttactgcagttgtgctttgcatatcggaaatgctggctaaataaacggtatcaaactaactctgaaagaacggcgccgcaaataacagcacccaattaaagaaccacaggattttagagattaaatgatctttttgagatccaagtacatctcatggtaggcaaggaaattgaattgcagagaagttgaaacactccttcacgttaatctaaaaatgcagatttccagaaatgtcgattataacaacagggcctgttacacaagtaatactggaaagaagccttagttttgtttgttttctaagagtgaaataggttaagtcagttctcagcaagagggagctagtgtatattcattgagaatgaattcagggctttagagttagactcgagtttggatgttagcttaactgccttttgtggctctatgactttgtgctgttaatcttcctcagtttcttcagttgtaaaatgggaatattcctttttgcagagttcagtctttcaataaacatttgaagtcttactgtacgtcatgcactgctgagctctagttaacagtgtggataataatgatagt

SEQ ID NO: 157715 - DNA, 4676 bp, Homo sapiens
  Payload ID: 10905
  Gene Symbol: NDUFV3
  Gene Name: NADH dehydrogenase (ubiquinone) flavoprotein 3, 10kDa
  Uniprot ID: P56181
  ENST ID: ENST00000340344
  CDS Start-End: 67-393
ggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaaggcccgctgtgcataatcggtttcacttttacctttttttttttttttttttttttgagacagggtctcactctgtcacccaggctggagtgcagtggcacattctcggctcactgcaacttccgcctcctgggttcaagtgattctcccacctcagcctcccaagtaggtgggattacaggtactcaccaccaggtccagctaacttttgtatttttagtagagacagggtttcaccatgttggccaggctggtctcgaactcctgacctcagatggtctgcccacctccgcctcccaaagtgctgggattacaggcgtgagccactgcgcccggccactttcacactttttacagtgagtggtgaattagcaacagtaacactgattatccaacatatattttggaatatctactatgtgcaaggaatttttcttaaactctaaggttatgaatcactgggcaaatccatataattagagaattttaagtgctttagagcggtgtgattctactgtgctcagcctagtcaatttcgcattaaactgattatcagctgagtatcaataatgtaatagtgacttcttttattttttttgagatggagtctctgtttcccaggctggagtccagcggcacaatctaaactcactgcaacctccgcctcctgggttcaagtgattctcctgccttacttagcctcttgagtagctggtactacaggctcacgccaccatgcctggctaattttttttgtatttttagtagagatggggtttcaccatcttggccaggctggtcttaaactcctgacctcatgatctacctgcctcagcctcccaaaatgctggcattataggcgtgagccactgcacccagccagtaatagtgacttctaatcctacagccctggtttttgatcattagaaacaggagttttggccaggtgcagtggataattcctgtaatcccagcgctttgggagggcgaggcgggtggagcacctgaggtcaggagttgagaccggcctggccaacatagtgaaaccccatctctactaaaaatacaaaaatcagccaggcatgctagtgggtacctgtaatcccagctactcaggaagctgaggcaggagaatcatttgaacctgggaggcggaggttgcagtgagcaagatcgtgccattgtactccagcctgggcaacaggagtgaaactcaatcaaaaaaaaggaacaggaatgttactaattttaactactgcattgcaaacaaattgtattgcagtattttaccatcagaaaaggaagggaattgttttgtttgcctctgttagatattttatataaacttgaggacattttcattggtgagattcggaagaggtgaagtttcttgcagtacagggacgaagtaggaagaggtgaagtttcgtgcagtacagggacggagtaggaagaggtgaagtttcgtgcagtacagggacggagtaggaagaggtgaagtttcgtgcggtgcagggacggagtaggaagaggtgaagtttcgtgcggtgcagggacggagtaggaagaggtgaagtttcgtgcggtgcagggacggagtaggaagaggtgaagttttgtgcggtgcagggacgaagttgctccccgctggccacaggcactcaatgagctattttacctatttagggtttctgggttggccaagtaacctcccatcccttgtgatagataactttaagtcacacctttgggggcaatgtggggggctcctgtgcatcacatggagcacgctcccccagcactctgcagagacagacccccagtctgacttagagaaagtaaccaatgtaggtgagggccagggcacggtggcttacgcctgtaatcccagcactttgggaagccaaggcggatggatcacttgaggtcaggagtttgagaccagcctggccaacatggtgaaaccctgtgtctactaaaaatacaaaaattagccaactgtggtggtgcgtgcctgtaatcccagctattcaagaggctgaggcaggagaatcgcttgaacccgggaggcggggtttgcagtaagccgagatcatgccattgcattcagtctgggtgacagcgtgagactgcatctcaaaaaaaaatttttttttttaaatatcaaaattgaaaactagtattgtggtcatctgcctcaaattgtgttaccacacgggagacttagcaactcagccagattcttctaaacacattttttataataaaagtggtaaaactacattaccaaaaagaaaatagtaaacttacctaaaatccactatgctaacccaccctttttttttttttttttttttttttttttttgagacagcctcactcttgcccggaggagtggtgcgatctcagctcactgcagcctcgtcctcccaggcccaagcaatcctcccatctcagcccactttgtagctgggactgtaggcactggccaccatgtccgcctaatttttctattttttgtagagacagggttcaagagatctgcctgcctcggccccagaaagttctgggattgcaggcgtgagcccccattcccagccattaacatcttacaggattccccagtggtggtggtaggtgtaaccattttaatgtacctacaacttttctatcctgctatttgcattttttggtttttcatttaatagttctcaagctgggatccgtggaactactgtgatgggcggtgatgctttggaaatggaaattcccttaatattaaaatgaacatgaatatattttgatttgcatatatttttaagataaagcatgagacttgtataaagttctttcctggctgggcgcggtggctcatgcctgtaatccctgcactttggaaggctgaggcagatggatcacctgaggttgggagtttgagaccagcctgactaacatggtgaaaccccctctctactaaaattacaaaattagccgggcgtgttggtgcatgcctgtaatcccagctactcaagaggctgaggcaggaaaatcacttgaacccaggaggcagaggctgcagtgagtggagattgcagcatcgcactacagcctgggcaacaacagcaaaactccgtctcaaaaaaataaagttcttcccttagaactagtcctgttgggctagtctttctgggattttggtttactctcctccacccattggaagggcttaaaaccgaatagccagcaccaagcacagctctgcattttgtagctatcactgcagatgatttcttgatagtccatctggtggcaatacagtggtcacccaaggggccattgtttgggtctatgtgatttcccacgttctgttggaggccgggcgcagtgcctcacgcctgtaatcccagcactttgggaggctgaggtgggcagatcacgaggtcaggagatcgagaccgtcctggctaacacggtgaaaccctgtctctactaaaaatacaaaaaattggccaggtgcggtggctcacgcctgtaatcccagcactttgggaggctgaggtgggcagatctcgaggtcaggagatcgagaccatcctggataacacggtgaaaccccgtctctattaaaaatacaaaaaattagccgggcatggtagcgggcgcctgtagtcccagctacttgggaggctgaggcaggagaatggcgtgaacccaggaggcggagcttgcagtgaaccgagatagcctcactgcactccagcctgggcgaaagagcaagactccgtctcaaaaaaaaaaaacaaaaaaaaaattagccgggcgtggtggtgggcgcctgtagtcccagctactcgggaggctgagacaggagaatgatgtgaacccgggaggcagagcttgcagtgagccgagattgtgccactgcactccagcctgggcgacagagcaagactccgtctcaaaaaataaattaattaattaaattaaataagtgggtgttttaagtgctcagcttccttggttctaccaccttctctccctgaccctccttccctttccccctgaccttggcctttattctagaacggatctgaagcaataggatataaaaaattcacaactgctaaaacagtgttccttctagtgtaattttcacccttagagacctgtctgtaataaacattatttgaaatgcctacta

SEQ ID NO: 157716 - DNA, 1575 bp, Homo sapiens
  Payload ID: 10905
  Gene Symbol: NDUFV3
  Gene Name: NADH dehydrogenase (ubiquinone) flavoprotein 3, 10kDa
  Uniprot ID: P56181
  ENST ID: ENST00000354250
  CDS Start-End: 70-1491
ggcggctgttcaggcgcgggtgcgcgcgcagctgctgtggccctgcttggtgcgcccgctgtcaccgccatggctgccccgtgtttgctgcggcaaggacgagccggggcgctgaagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccaggggacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactgagggccctcggtgtgaagatgaaccttccaccgtcttcactgcatcctggagtgcaaaaataaaatccactcaagagtcacaagg

SEQ ID NO: 157717 - DNA, 621 bp, Homo sapiens; identical to SEQ ID NO: 157458
  Payload ID: 10906
  Gene Symbol: NDUFA10
  Gene Name: NADH dehydrogenase [ubiquinone] 1 alpha subcomplex subunit 10, mitochondrial
  ENST ID: ENST00000627686
  CDS Start-End: 1-400

SEQ ID NO: 157718 - DNA, 1489 bp, Homo sapiens; identical to SEQ ID NO: 157462
  Payload ID: 10906
  Gene Symbol: NDUFA10
  Gene Name: NADH dehydrogenase [ubiquinone] 1 alpha subcomplex subunit 10, mitochondrial
  ENST ID: ENST00000628011
  CDS Start-End: 45-1112

SEQ ID NO: 157719 - DNA, 776 bp, Homo sapiens; identical to SEQ ID NO: 157461
  Payload ID: 10906
  Gene Symbol: NDUFA10
  Gene Name: NADH dehydrogenase [ubiquinone] 1 alpha subcomplex subunit 10, mitochondrial
  ENST ID: ENST00000626554
  CDS Start-End: 43-776

SEQ ID NO: 157720 - DNA, 1557 bp, Homo sapiens; identical to SEQ ID NO: 157456
  Payload ID: 10906
  Gene Symbol: NDUFA10
  Gene Name: NADH dehydrogenase [ubiquinone] 1 alpha subcomplex subunit 10, mitochondrial
  ENST ID: ENST00000630225
  CDS Start-End: 6-1178

SEQ ID NO: 157721 - DNA, 662 bp, Homo sapiens; identical to SEQ ID NO: 157459
  Payload ID: 10906
  Gene Symbol: NDUFA10
  Gene Name: NADH dehydrogenase [ubiquinone] 1 alpha subcomplex subunit 10, mitochondrial
  ENST ID: ENST00000628405
  CDS Start-End: 1-390

SEQ ID NO: 157722 - DNA, 699 bp, Homo sapiens; identical to SEQ ID NO: 157455
  Payload ID: 10906
  Gene Symbol: NDUFA10
  Gene Name: NADH dehydrogenase [ubiquinone] 1 alpha subcomplex subunit 10, mitochondrial
  ENST ID: ENST00000626935
  CDS Start-End: 7-612

SEQ ID NO: 157723 - DNA, 4915 bp, Homo sapiens; identical to SEQ ID NO: 157453
  Payload ID: 10906
  Gene Symbol: NDUFA10
  Gene Name: NADH dehydrogenase [ubiquinone] 1 alpha subcomplex subunit 10, mitochondrial
  ENST ID: ENST00000630647
  CDS Start-End: 102-1169

SEQ ID NO: 157724 - DNA, 434 bp, Homo sapiens; identical to SEQ ID NO: 157460
  Payload ID: 10906
  Gene Symbol: NDUFA10
  Gene Name: NADH dehydrogenase [ubiquinone] 1 alpha subcomplex subunit 10, mitochondrial
  ENST ID: ENST00000627439
  CDS Start-End: 1-417

SEQ ID NO: 157725 - DNA, 562 bp, Homo sapiens; identical to SEQ ID NO: 157457
  Payload ID: 10906
  Gene Symbol: NDUFA10
  Gene Name: NADH dehydrogenase [ubiquinone] 1 alpha subcomplex subunit 10, mitochondrial
  ENST ID: ENST00000630302
  CDS Start-End: 13-297

SEQ ID NO: 157726 - DNA, 1313 bp, Homo sapiens; identical to SEQ ID NO: 157454
  Payload ID: 10906
  Gene Symbol: NDUFA10
  Gene Name: NADH dehydrogenase [ubiquinone] 1 alpha subcomplex subunit 10, mitochondrial
  ENST ID: ENST00000626224
  CDS Start-End: 24-1313

SEQ ID NO: 157727 - DNA, 580 bp, Homo sapiens
  Payload ID: 10907
  Gene Symbol:
  Gene Name: NADH dehydrogenase [ubiquinone] 1 alpha subcomplex subunit 7  [Source:UniProtKB/Swiss-Prot
  Acc:O95182]
  Uniprot ID: O95182
  ENST ID: ENST00000598884
  CDS Start-End: 22-363
cttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcagccgcgggcgccgcagaactcaggggcttgggccccgccccaaccccgcgcgtgcgcgtgcgcagggataagagagcggtctggacagcgcgtggccggcgccgctgtggggacagcatgagcgg

SEQ ID NO: 157728 - DNA, 1857 bp, Homo sapiens
  Payload ID: 10908
  Gene Symbol: NOXRED1
  Gene Name: NADP-dependent oxidoreductase domain containing 1
  Uniprot ID: Q6NXP6
  ENST ID: ENST00000380835
  CDS Start-End: 168-1247
aaattcagaatctgggagtagagaggtgctgaagcccatcatcatgagtgcttgtgacctgggcacacacaccatcatacacacacctcctacatagacccctcttctaccgggacagggagccaaattgattagtgtctatcactgcaggaaatagtggcttggaaatggacatgctccaggaccttgagtccctgcagtttgagtatggggttccagaggaagatcgtatctggctgtatttgcagggccgttctcggggactgatgatcgaggcttgtgcccatgcaaccttcttctgcaaactattatataatttgagagcatcattaaataagaatcaaagttccagacatctctcaattggctcccttaattcagccactcctgaagagtttaaggtgggcatcattggaggtggccaccttgggaagcagctggctggcacactgctgcagcttggccccatccctgctgaaagcctgcggatctccactcggaggccagagactctgggtgagctccagaagctgggaatcaaatgcttttaccataacgctgatctggtgagttgggccgatgtgatattcctctgctgcttgccgtctcagctgcctaatatctgcgtagaaatttacaccagccttgagaaggccagcattgtgtacagctttgtagctgccatcccactacccaggctgaaactactgttgaaccacaccaatatcttgcggcctcagtatcagtatgatgaagattctgtcagcgtctggggggccaataagggagtcatagctgctctccaagatcctacgattcttcaagctacctgtccctacagtcctgctgggggaataatcctcaatatcaagtggttggagggagtgttctatgcggccctaaacatatgcacagcaagaaacatggcccactcccaagtgctgcagcttctgagtgaactctttctctccgtgcactttgaagactgtgggaaagacacagcatcttgcccaaagttgcaattaacagattttgtcagcaaagcctatggcaagaatttgtctcaggaaaggcctttcccctggtttgatctgactgctgtgcaactcaaggaaactccgtttagccagcatctctcaagtagtcctgttctccaagaccaccttacccatctatactgtgcttcatttggcatctccctaaccaaagaacagccagtcatttccacaggctttccatcccaataagagaactcaggaatcaggattttttcccactcacagattttccctataatagttgtgccctgattatcacaattgactgtgggagtcttgtggctgtattgtgtttgccacatgatagacatcaggaattataaaactgtactgatgactctttaaaatgtagaataaaacaagtggtcctatccatcaatatgtatctggctctcagaagcaactagtgaaactacacaacctaacttaagtaagctgctcccgcagaaaagtcttgttaatacaaattatttctcttctaaaattaaagaagttataatgttataagttttagacaattacatactgcagcttcttttccaataaatcaagtttcaatccatttgccagcagtaggtagctggaaaaagatacagtttgattttctcacaattttggacagagaagtgaaggtatggtaaaccatcttaattgaattatggcttgtatcatgcttattttgactatatatgactgttctggtactatcttatttacagctgttcccatttaaaccatttaaaaaactggtatttaatggctaaaactaattttgcaaaatatagatctatactgcaaa

SEQ ID NO: 157729 - DNA, 734 bp, Homo sapiens
  Payload ID: 10908
  Gene Symbol: NOXRED1
  Gene Name: NADP-dependent oxidoreductase domain containing 1
  ENST ID: ENST00000555603
  CDS Start-End: 65-734
ttccaggatcagaagtactgaggagcagagccaatcttctctgtttggaaatagtggcttggaaatggacatgctccaggaccttgagtccctgcagtttgagtatggggttccagaggaagatcgtatctggctgtatttgcagggccgttctcggggactgatgatcgaggcttgtgcccatgcaaccttcttctgcaaactattatataatttgagagcatcattaaataagaatcaaagttccagacatctctcaattggctcccttaattcagccactcctgaagagtttaaggtgggcatcattggaggtggccaccttgggaagcagctggctggcacactgctgcagcttggccccatccctgctgaaagcctgcggatctccactcggaggccagagactctgggtgagctccagaagctgggaatcaaatgcttttaccataacgctgatctggtgagttgggccgatgtgatattcctctgctgcttgccgtctcagctgcctaatatctgcgtagaaatttacaccagccttgagaaggccagcattgtgtacagctttgtagctgccatcccactacccaggctgaaactactgttgaaccacaccaatatcttgcggcctcagtatcagtatgatgaagattctgtcagcgtctggggggccaataagggagtcatagctgctctccaagatcctacgattcttcaagctacctgtccct

SEQ ID NO: 157730 - DNA, 2495 bp, Homo sapiens
  Payload ID: 10909
  Gene Symbol: NDOR1
  Gene Name: NADPH dependent diflavin oxidoreductase 1
  Uniprot ID: Q9UHB4
  ENST ID: ENST00000344894
  CDS Start-End: 109-1902
acttccggtcgacggcggaaggcggaaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaatggtggcctctgggtggtta

SEQ ID NO: 157731 - DNA, 2497 bp, Homo sapiens
  Payload ID: 10909
  Gene Symbol: NDOR1
  Gene Name: NADPH dependent diflavin oxidoreductase 1
  Uniprot ID: Q9UHB4
  ENST ID: ENST00000371521
  CDS Start-End: 84-1904
aaggcggagcggtccctgcaacccggccggcgggaactgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacagcccccagccctgttctctgccctacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaatggtggcctctgggtggtta

SEQ ID NO: 157732 - DNA, 1829 bp, Homo sapiens
  Payload ID: 10909
  Gene Symbol: NDOR1
  Gene Name: NADPH dependent diflavin oxidoreductase 1
  Uniprot ID: Q9UHB4
  ENST ID: ENST00000458322
  CDS Start-End: 29-1801
ctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctggggcccgacgctgctgtggacccctggctgcgagacttgtgggacagggttctggggctgtacccgccgcctccgggcctcactgagatccctcccggagtccccctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccagggtgcatacttctacctggcaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctga

SEQ ID NO: 157733 - DNA, 2315 bp, Homo sapiens
  Payload ID: 10909
  Gene Symbol: NDOR1
  Gene Name: NADPH dependent diflavin oxidoreductase 1
  Uniprot ID: Q9UHB4
  ENST ID: ENST00000427047
  CDS Start-End: 73-1638
gtccctgcaacccggccggcgggaactgccttctagtttttagtctcagaccagaccaccgggcgcaccccgatgccgagcccgcagcttctggtgctcttcggcagccagacaggcacggctcaggatgtgtcggagagactgggtcgcgaggcccggcgccggcggcttggctgccgggtgcaggccctggactcctacccggtggtgaatctgattaacgagcccctggtgatatttgtttgtgcaactacaggccaaggagacccccctgacaacatgaagaacttctggaggtttatattccggaagaacctgccctccactgccctctgtcagatggactttgccgtcctgggcctcggggactcctcatacgccaagttcaacttcgtggccaagaagctgcaccgacggctactgcagcttgggggcagcgccctcctgcccgtgtgcctgggcgatgaccagcatgagctgggcctgccctccaagttcaccctgctgttcctccaagaggcacccagcacgggctctgaggggcagcgggtagctcaccccggctctcaggagcccccgtcagagtcgaagcccttcctagcacccatgatctccaaccagagagtcaccggcccctcccacttccaggacgttcggctgattgagtttgacatcttgggctctggcatcagctttgctgctggtgatgtggtgctgattcagccctccaactcggctgcccatgtccagcggttctgccaggtgctgggcctggaccctgaccagctcttcatgctgcagccgcgggagccagatgtctcctcccccacgaggctgccccagccctgctccatgcggcacctcgtgtcccactacctggacatcgccagcgtgcctcgccgctccttcttcgaactcctggcctgtctatccctccatgagctggagcgggagaagctgctggagttcagttctgcccaaggccaggaggagctctttgaatactgcaaccggccccgcaggaccatcctggaggtgctctgtgacttcccgcacacagctgccgccatccctcccgactacctgttggacctcatccccgttatccggccgagggccttctccatcgcctcctcgctgctgactcacccctcacggctgcagatcctcgtggctgtagtgcagttccagactcgcctcaaggagccccgccggggcctctgctcctcctggctggcatccctggaccctgggcaaggacctgtccgggtgcccctctgggtgcggcctgggagtctggccttcccagagacaccagacacacctgtgatcatggtggggcctggcactggggtagcccccttccgagcagccatccaggagcgtgtggcccagggccagactggaaacttcttgttttttggctgccgctggcgggaccaagacttctactgggaggctgagtggcaggagctggagaagcgggactgtctgaccctcatccctgccttctcccgggaacaggagcagaaagtatatgtgcagcaccggctccgggagctggggtcgcttgtgtgggaactgctggaccgccaggcaacgccaagtccatgccagcggacgtctcggaagccctgatgtccatcttccaggaggagggtggactctgcagcccggacgcagccgcgtatctagccaggctccagcagacacggcgcttccagacagagacgtgggcctgaggcccgcggctgcccgtgccccctctgacagccatcctcctgggagcccaggaaggcatccacgagggagctcctggccagcagccgtcatcctctcggaccagccagctggtcctctgggaacagccagctcccgagcacagccgcactcctgttgaccctggatcccaccctttgagcctgaccccactgcagcctctgcccagccagccctgcgctcccccaccctgacagtgagctgtgtcctcgtccccccacccccttcccagtcaaggtggtggcctgggccgctccacctcaccggtgcagtgacccaggacggcatcagcagcccagtgagcaccaggggtggcatagggcacccatgaggctgcgctgcactcctctgccctggggccacctcggctgctgcagcctgcccagcagcacattccagtcactgcccccgcactcccacagggctcaggctgggctcagaggccactgagatgccagctccttgagagcagtgggggtgtcccaggccagagcagcctcttcctctcctggtcccagaaaaacccttgcagtaaa

SEQ ID NO: 157734 - DNA, 1734 bp, Homo sapiens
  Payload ID: 10910
  Gene Symbol: NOX1
  Gene Name: NADPH oxidase 1
  Uniprot ID: Q9Y5S8
  ENST ID: ENST00000217885
  CDS Start-End: 71-1618
ggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaaggttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttg

SEQ ID NO: 157735 - DNA, 2418 bp, Homo sapiens
  Payload ID: 10910
  Gene Symbol: NOX1
  Gene Name: NADPH oxidase 1
  ENST ID: ENST00000372960
  CDS Start-End: 207-1790
gctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggttttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattcttatttttgctcatcaaaaaataaaggattttcttcttcacttga

SEQ ID NO: 157736 - DNA, 661 bp, Homo sapiens
  Payload ID: 10910
  Gene Symbol: NOX1
  Gene Name: NADPH oxidase 1
  ENST ID: ENST00000372964
  CDS Start-End: 71-649
ggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccatccccatataacaccaacagtgtacatgtttactgtcacttttgatatggtcttatccagtgtgaacagcaatttattcttatttttgctcatcaaaaaataaaggattttcttc

SEQ ID NO: 157737 - DNA, 2529 bp, Homo sapiens
  Payload ID: 10910
  Gene Symbol: NOX1
  Gene Name: NADPH oxidase 1
  Uniprot ID: Q9Y5S8
  ENST ID: ENST00000372966
  CDS Start-End: 207-1901
gctgatagcacagttctgtccagagaaggaaggcagaataaacttattcattcccaggaactcttggggtaggtgtgtgtttttcacatcttaaaggctcacagaccctgcgctggacaaatgttccattcctgaaggacctctccagaatccggattgctgaatcttccctgttgcctagaagggctccaaaccacctcttgacaatgggaaactgggtggttaaccactggttttcagttttgtttctggttgtttggttagggctgaatgttttcctgtttgtggatgccttcctgaaatatgagaaggccgacaaatactactacacaagaaaaatccttgggtcaacattggcctgtgcccgagcgtctgctctctgcttgaattttaacagcacgctgatcctgcttcctgtgtgtcgcaatctgctgtccttcctgaggggcacctgctcattttgcagccgcacactgagaaagcaattggatcacaacctcaccttccacaagctggtggcctatatgatctgcctacatacagctattcacatcattgcacacctgtttaactttgactgctatagcagaagccgacaggccacagatggctcccttgcctccattctctccagcctatctcatgatgagaaaaaggggggttcttggctaaatcccatccagtcccgaaacacgacagtggagtatgtgacattcaccagcattgctggtctcactggagtgatcatgacaatagccttgattctcatggtaacttcagctactgagttcatccggaggagttattttgaagtcttctggtatactcaccacctttttatcttctatatccttggcttagggattcacggcattggtggaattgtccggggtcaaacagaggagagcatgaatgagagtcatcctcgcaagtgtgcagagtcttttgagatgtgggatgatcgtgactcccactgtaggcgccctaagtttgaagggcatccccctgagtcttggaagtggatccttgcaccggtcattctttatatctgtgaaaggatcctccggttttaccgctcccagcagaaggttgtgattaccaaggttgttatgcacccatccaaagttttggaattgcagatgaacaagcgtggcttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaagtgggttttctaaactaccgtctcttcctcaccggatgggacagcaatattgttggtcatgcagcattaaactttgacaaggccactgacatcgtgacaggtctgaaacagaaaacctcctttgggagaccaatgtgggacaatgagttttctacaatagctacctcccaccccaagtctgtagtgggagttttcttatgtggccctcggactttggcaaagagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcagcaacttaagaacttctgaagttcttaaagttctgaagttcttaaagcccatggatcctttctcagaaaaataactgtaaatctttctggacagccatgactgtagcaaggcttgatagcagaggtttggtggttcagagttatacaactaatcccaggtgattttatcaattccagtgttaccatctcctgagttttggtttgtaatcttttgtccctcccacccccacagaagatttctaagtagggtgactttttaaataaaaatttattgaataattaatgataaaacataataataaacataaataataaacaaaattaccgagaaccccatccccatataacaccaacagtgtacatgtttactgtcacttttgatatggtcttatccagtgtgaacagcaatttattcttatttttgctcatcaaaaaataaaggattttcttcttcacttga

SEQ ID NO: 157738 - DNA, 695 bp, Homo sapiens
  Payload ID: 10910
  Gene Symbol: NOX1
  Gene Name: NADPH oxidase 1
  ENST ID: ENST00000427768
  CDS Start-End: 1-526
cttcagcatggaagtggggcagtatatctttgttaattgcccctcaatctctctcctggaatggcatccttttactttgacctctgctccagaggaagatttcttctccattcatatccgagcagcaggggactggacagaaaatctcataagggctttcgaacaacaatattcaccaattcccaggattgaagtggatggtccctttggcacagccagtgaggatgttttccagtatgaagtggctgtgctggttggagcaggaattggggtcaccccctttgcttctatcttgaaatccatctggtacaaattccagtgtgcagaccacaacctcaaaacaaaaaagatctatttctactggatctgcagggagacaggtgccttttcctggttcaacaacctgttgacttccctggaacaggagatggaggaattaggcaaaagcctgcgcaaatgctgtcaccgatattccagtctggatcctagaaaggttcaattctacttcaacaaagaaaatttttgagttataggaataaggacggtaatctgcattttgtctctttgtatcttcagtaatttacttggtctcgtcaggtttgagcagtcactttaggataagaatgtgcctctcaagccttgactccctggtattctttttttgattgcattcaacttcgttacttgagcttcag

SEQ ID NO: 157739 - DNA, 2042 bp, Homo sapiens
  Payload ID: 10911
  Gene Symbol: NOX3
  Gene Name: NADPH oxidase 3
  Uniprot ID: Q9HBY0
  ENST ID: ENST00000159060
  CDS Start-End: 104-1810
caaagacaaaataatttactagggaagcccttactaacgacccaacatccagacacaggtgagggagaagaaatttcctgacagccgaagagcaacaagtatcatgatggggtgctggattttgaatgagggtctctccaccatattagtactctcatggctgggaataaatttttatctgtttattgacacgttctactggtatgaagaggaggagtctttccattacacacgagttattttgggttcaacactggcttgggcacgagcatccgcactgtgcctgaattttaactgcatgctaattctaatacctgtcagtcgaaaccttatttcattcataagaggaacaagtatttgctgcagaggaccgtggaggaggcaattagacaaaaacctcagatttcacaaactggtcgcctatgggatagctgttaatgcaaccatccacatcgtggcgcatttcttcaacctggaacgctaccactggagccagtccgaggaggcccagggacttctggccgcactttccaagctgggcaacacccctaacgagagctacctcaaccctgtccggaccttccccacaaacacaaccactgaattgctaaggacaatagcaggcgtcaccggtctggtgatctctctggctttagtcttgatcatgacctcgtcaactgagttcatcagacaggcctcctatgagttgttctggtacacacaccatgttttcatcgtcttctttctcagcctggccatccatgggacgggtcggattgttcgaggccaaacccaagacagtctctctctgcacaacatcaccttctgtagagaccgctatgcagaatggcagacagtggcccaatgccccgtgcctcaattttctggcaaggaaccctcggcttggaaatggattttaggccctgtggtcttgtatgcatgtgaaagaataattaggttctggcgatttcaacaagaagttgtcattaccaaggtggtaagccacccctctggagtcctggaacttcacatgaaaaagcgtggctttaaaatggcgccagggcagtacatcttggtgcagtgcccagccatatcttcgctggagtggcaccccttcacccttacctctgccccccaggaggactttttcagcgtgcacatccgggcagcaggagactggacagcagcgctactggaggcctttggggcagagggacaggccctccaggagccctggagcctgccaaggctggcagtggacgggccctttggaactgccctgacagatgtatttcactacccagtgtgtgtgtgcgttgccgcggggatcggagtcactcccttcgctgctcttctgaaatctatatggtacaaatgcagtgaggcacagaccccactgaagctgagcaaggtgtatttctactggatttgccgggatgcaagagcttttgagtggtttgctgatctcttactctccctggaaacacggatgagtgagcaggggaaaactcactttctgagttatcatatatttcttaccggctgggatgaaaatcaggctcttcacatagctttacactgggacgaaaatactgacgtgattacaggcttaaagcagaagaccttctatgggaggcccaactggaacaatgagttcaagcagattgcctacaatcaccccagcagcagtattggcgtgttcttctgtggacctaaagctctctcgaggacacttcaaaagatgtgccacttgtattcatcagctgaccccagaggtgttcatttctattacaacaaggagagcttctagactttggaggtcaagtccaggcattgtgttttcaatcaagttattgattccaaagaactccaccaggaattcctgtgacggcctgttgatatgagctcccagttgggaactggtgaataataattaactattgtgaacagtacactataccatacttccttagcttataaataacatgtcatatacaacagaacaaaaacatttactgaaattaaaatatattatgtttctc

SEQ ID NO: 157740 - DNA, 2388 bp, Homo sapiens
  Payload ID: 10912
  Gene Symbol: NOX4
  Gene Name: NADPH oxidase 4
  Uniprot ID: Q9NPH5
  ENST ID: ENST00000263317
  CDS Start-End: 240-1976
tgagtgggcagagctgacccggtgcgggtgggagtcagggcgcccggaaaacccggctctgggtagcagaccccgcccgggctggctcggcgccgggccttcgggcttccactcagtctttgaccctcggtcctcgctcagcggcccggcaggccgcacaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaa

SEQ ID NO: 157741 - DNA, 3347 bp, Homo sapiens
  Payload ID: 10912
  Gene Symbol: NOX4
  Gene Name: NADPH oxidase 4
  Uniprot ID: Q9NPH5
  ENST ID: ENST00000343727
  CDS Start-End: 295-1959
attctctgagcgtgcacgggtgggaagctggaagtggaagttttgtcttaattcgaacattctcaacttacaaaactttatgctggagataacaatgaacactccccctcccaccccctcgcctgtcccccaaatgcatgagaatttttctgcacattgatgggagagatgtggaggaagagggaagaggtcattttccgtgaatacagcttttctttttaccctttaaacatttttgctccctttgttcttttcccagattacttctgtttgcttgggttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtgttgtgtataaacagagtagctttaatttgcaagcactccaggcaaatatattagatgtttgaaaacacagcacaagactctgtattgatacgggtactttgtgtcaatatctaatcgtctccactacttatgctaatacctctatttgatatctgaagactatatgctaactgaaccttcctcaaatgttgttatagtatctatttttatatatttttttctttttattcctctctctagggaaatatgccttcccttagcatgcattagacataatgatttaataggtccctttcatcttcatttaaatctatcactattgcatggtaatgaaaatattcctactataaattataaagggatatatatatatggatatatatatgtatatacacatatatatatacacacacacacacatatatatatatatatatatatatacacatatactaataacttttcccttttttcagcatttttgtctctattattattattgtttttttcccaggtagggtttgtcttaggctgtagcctctaaggatagttagttaatttgcactttgagaccaaaggacatcatgtgtgtcagtagggactgaatataagatttatctcctttgccacacattggtttatgatggagacattgaaagtctagtcatattcctgaacagtaaaacctgtattttaccttttaagtaagaggaaatatgatattcttattcaaacttaagtttagaatccagaatattactgtcgcactttttggtatcctgagtttccatagggaactattgggtttaaagtcaccgttggaactacactgtgtgatcttataaacttatgttccctggctatcatattcttggctcagaacaatatttcccattactatcttaagaattaaggcattcatggctcacgcctgtaatcccggcactttgggaggccaaggc

SEQ ID NO: 157742 - DNA, 816 bp, Homo sapiens
  Payload ID: 10912
  Gene Symbol: NOX4
  Gene Name: NADPH oxidase 4
  Uniprot ID: Q9NPH5
  ENST ID: ENST00000375979
  CDS Start-End: 1-816
atggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 157743 - DNA, 560 bp, Homo sapiens
  Payload ID: 10912
  Gene Symbol: NOX4
  Gene Name: NADPH oxidase 4
  Uniprot ID: Q9NPH5
  ENST ID: ENST00000393282
  CDS Start-End: 320-484
cctagacaaaggggccggcgcggcggagcagactggtgcagcctgggccgcgcgctcagagcgctgggcgtctgggcagctgagtgggcagagctgacccggtgcgggtgggagtcagggcgcccggaaaacccggctctgggtagcagaccccgcccgggctggctcggcgccgggccttcgggcttccactcagtctttgaccctcggtcctcgctcagcggcccggcaggccgcacaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttgggggaactgtcttgaaacctatacatttcagatgggcacccagagagtaagacctcacctcgcccctcaagttgcttacaatataatggaa

SEQ ID NO: 157744 - DNA, 4184 bp, Homo sapiens
  Payload ID: 10912
  Gene Symbol: NOX4
  Gene Name: NADPH oxidase 4
  Uniprot ID: Q9NPH5
  ENST ID: ENST00000424319
  CDS Start-End: 120-1784
tgcagtgtcgaataggtacctgggtcaactccacacacttctcactcttcactggacctctggtacaagattgagaggattcctattacttacaaacagactagttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtgttgtgtataaacagagtagctttaatttgcaagcactccaggcaaatatattagatgtttgaaaacacagcacaagactctgtattgatacgggtactttgtgtcaatatctaatcgtctccactacttatgctaatacctctatttgatatctgaagactatatgctaactgaaccttcctcaaatgttgttatagtatctatttttatatatttttttctttttattcctctctctagggaaatatgccttcccttagcatgcattagacataatgatttaataggtccctttcatcttcatttaaatctatcactattgcatggtaatgaaaatattcctactataaattataaagggatatatatatatggatatatatatgtatatacacatatatatatacacacacacacacatatatatatatatatatatatatacacatatactaataacttttcccttttttcagcatttttgtctctattattattattgtttttttcccaggtagggtttgtcttaggctgtagcctctaaggatagttagttaatttgcactttgagaccaaaggacatcatgtgtgtcagtagggactgaatataagatttatctcctttgccacacattggtttatgatggagacattgaaagtctagtcatattcctgaacagtaaaacctgtattttaccttttaagtaagaggaaatatgatattcttattcaaacttaagtttagaatccagaatattactgtcgcactttttggtatcctgagtttccatagggaactattgggtttaaagtcaccgttggaactacactgtgtgatcttataaacttatgttccctggctatcatattcttggctcagaacaatatttcccattactatcttaagaattaaggcattcatggctcacgcctgtaatcccggcactttgggaggccaaggcaggtggatcacgaggtcagagttcaagaccagcctgaccaagttggtgaaaccccatcgctactaaaaatacaaatattaggcgggtgtggtggcgggtgcctataatcccaactactcgggagactgaggcaaagaatcgcttgaacccggtgggcggaggttgcagtgagccaagattgcaccactgcactccagcctgggtgacagagcaagattccatctcaaaaaaaaaaaaaaaaaaaaaaaaaaagaattaaagcattcatacagtttagtgattttgtttagtagtcggctatcaattgctatcaaatataacactgctgaaatcagcagtgtgacttaccttgccattgttaaaatgttacataaaacataacatgatagatgctaaggcctttttttgctataattcaccaatagcaatcaagcatgctaacccatactgaatgatatttacttgtagatatttcttcctttccttgaaattctcctttctatggaaagaagatgaacccaaaaaagtgataggaaatgtggaatgctcatgcagatttagctctgaaggcatatttaataactagtatgtcttgacaacagtctttagattaaaaagaattttcatggaaacatttaacagaaagaactagtaaaaagacactttgagttagtccaggcttaatgtgcaatactgactctatactgatcataatttatttatgcgatcatattaatagacctaatttcattaaaacaggtagaagatttttcaaaagaaagatgatgtttcaaagctggtctgccattctagatgagcctccttgcttatttaagttccagtaggtgttcaaatgttaaatgttaaacataggtcatctttgcttctgcagggcttcatcttgcatgtttaagagaactttgttttattttgagggattatttctctggggatcattcttataatacaagccttaaatcactaattttagtagcaataaatgttaaaattg

SEQ ID NO: 157745 - DNA, 2379 bp, Homo sapiens
  Payload ID: 10912
  Gene Symbol: NOX4
  Gene Name: NADPH oxidase 4
  Uniprot ID: Q9NPH5
  ENST ID: ENST00000527956
  CDS Start-End: 306-1970
tacttctagtctagttggagaaacaacctagaaaatgcaccaacaaatggggcacaataactactctgagagagagtggcacacagtggacgcaaagaagaggttcctgatgcagctgggaagagtctacatgggcctctagcaggagaagatactggtcttgagtttggagactaagtaagcatctccagtgtcgaataggtacctgggtcaactccacacacttctcactcttcactggacctctggtacaagattgagaggattcctattacttacaaacagactagttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctg

SEQ ID NO: 157746 - DNA, 2039 bp, Homo sapiens
  Payload ID: 10912
  Gene Symbol: NOX4
  Gene Name: NADPH oxidase 4
  Uniprot ID: Q9NPH5
  ENST ID: ENST00000532825
  CDS Start-End: 86-1630
acacttctcactcttcactggacctctggtacaagattgagaggattcctattacttacaaacagactagttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaaggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctg

SEQ ID NO: 157747 - DNA, 696 bp, Homo sapiens
  Payload ID: 10912
  Gene Symbol: NOX4
  Gene Name: NADPH oxidase 4
  Uniprot ID: Q9NPH5
  ENST ID: ENST00000531342
  CDS Start-End: 1-696
atggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggtgtccaactgaaaccaaagcaacatttggggttcatcttaaaatagtaggagactggacagaacgatttcgagatttactactgcctccatctagtcaagactccgaaattctgcccttcattcaatctagaaattatcccaaggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 157748 - DNA, 1403 bp, Homo sapiens
  Payload ID: 10912
  Gene Symbol: NOX4
  Gene Name: NADPH oxidase 4
  Uniprot ID: Q9NPH5
  ENST ID: ENST00000529343
  CDS Start-End: 112-786
ggtcctcgctcagcggcccggcaggccgcacaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctga

SEQ ID NO: 157749 - DNA, 1774 bp, Homo sapiens
  Payload ID: 10912
  Gene Symbol: NOX4
  Gene Name: NADPH oxidase 4
  ENST ID: ENST00000527626
  CDS Start-End: 259-1434
acaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttggttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgt

SEQ ID NO: 157750 - DNA, 1555 bp, Homo sapiens
  Payload ID: 10912
  Gene Symbol: NOX4
  Gene Name: NADPH oxidase 4
  ENST ID: ENST00000525196
  CDS Start-End: 115-1143
ctcggtcctcgctcagcggcccggcaggccgcacaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaa

SEQ ID NO: 157751 - DNA, 2156 bp, Homo sapiens
  Payload ID: 10912
  Gene Symbol: NOX4
  Gene Name: NADPH oxidase 4
  Uniprot ID: Q9NPH5
  ENST ID: ENST00000534731
  CDS Start-End: 83-1699
acaactgtaaccgctgccccggccgccgcccgctccttctcggtccggcgggcacagagcgcagcgcggcggggccggcggcatggctgtgtcctggaggagctggctcgccaacgaaggggttaaacacctctgcctgttcatctggctctccatgaatgtcctgcttttctggaaaaccttcttgctgtataaccaagggccagagtatcactacctccaccagatgttggggctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaaggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaaccaaagagaccctgaagaatatttgatgtgatgattcacttttcagttctcaaattaaaagaaaactgttagatgcacactgttgattttcatggtggattcaagaactccctagtgaggagctgaacttgctcaatctaaggctgattgtcgtgttcctctttaaattgtttttggttgaacaaatgcaagattgaacaaaattaaaaattcattgaagctgaaattccattttctgtgttgtgtataaacagagtagctttaatttgca

SEQ ID NO: 157752 - DNA, 1899 bp, Homo sapiens
  Payload ID: 10912
  Gene Symbol: NOX4
  Gene Name: NADPH oxidase 4
  ENST ID: ENST00000528341
  CDS Start-End: 49-1710
cagatttgttttcctctgagtggttttcagcttgctggttaattgaaaatgctttctgcagttactgatttaggttccattgaaagcactgtgtcgaagaatttacctgtggtttctattcatcagctaggattgtgtctaagcagagcctcagcatctgttcttaacctcaactgcagccttatccttttacccatgtgccgaacactcttggcttacctccgaggatcacagaaggttccaagcaggagaaccaggagattgttggataaaagcagaacattccatattacctgtggtgttactatctgtattttctcaggcgtgcatgtggctgcccatctggtgaatgccctcaacttctcagtgaattacagtgaagactttgttgaactgaatgcagcaagataccgagatgaggatcctagaaaacttctcttcacaactgttcctggcctgacaggggtctgcatggtggtggtgctattcctcatgatcacagcctctacatatgcaataagagtttctaactatgatatcttctggtatactcataacctcttctttgtcttctacatgctgctgacgttgcatgtttcaggagggctgctgaagtatcaaactaatttagatacccaccctcccggctgcatcagtcttaaccgaaccagctctcagaatatttccttaccagagtatttctcagaacattttcatgaacctttccctgaaggattttcaaaaccggcagagtttacccagcacaaatttgtgaagatttgtatggaagagcccagattccaagctaattttccacagacttggctttggatttctggacctttgtgcctgtactgtgccgaaagactttacaggtatatccggagcaataagccagtcaccatcatttcggtcatgagtcatccctcagatgtcatggaaatccgaatggtcaaagaaaattttaaagcaagacctggtcagtatattactctacattgtcccagtgtatctgcattagaaaatcatccatttaccctcacaatgtgtccaactgaaaccaaagcaacatttggggttcatcttaaaatagtaggagactggacagaacgatttcgagatttactactgcctccatctagtcaagactccgaaattctgcccttcattcaatctagaaattatcccaagctgtatattgatggtccttttggaagtccatttgaggaatcactgaactatgaggtcagcctctgcgtggctggaggcattggagtaactccatttgcatcaatactcaacaccctgttggatgactggaaaccatacaagcttagaagactatactttatttgggtatgcagagatatccagtccttccgttggtttgcagatttactctgtatgttgcataacaagttttggcaagagaacagacctgactatgtcaacatccagctgtacctcagtcaaacagatgggatacagaagataattggagaaaaatatcatgcactgaattcaagactgtttataggacgtcctcggtggaaacttttgtttgatgaaatagcaaaatataacagaggaaaaacagttggtgttttctgttgtggacccaattcactatccaagactcttcataaactgagtaaccagaacaactcatatgggacaagatttgaatacaataaagagtctttcagctgaaaacttttgccatgaagcaggactctaaagaaggaatgagtgcaatttctaagactttgaaactcagcggaatcaatcagctgtgttatgccaaagaatagtaaggttttcttatttatgattatttaaaatggaaatgtgagaatgtggcaagatgaccgtcacattacatgtttaatctggaaacca

SEQ ID NO: 157753 - DNA, 1678 bp, Homo sapiens
  Payload ID: 10913
  Gene Symbol: NOXA1
  Gene Name: NADPH oxidase activator 1
  Uniprot ID: Q86UR1
  ENST ID: ENST00000341349
  CDS Start-End: 181-1632
ccggggaggggcgggcgcctgccgccagggggcgccgcggggcagcggggttgcacctggcgcttggcgcccgcacctctgcccgcctcggagaccccgcagccccgcgccgccgcctggccccggccccggcccctccgcgggatcctggcccctcctcgagcgccgccaccggccgccatggcctctctgggggacctggtgcgcgcctggcacctgggcgcgcaggctgtggatcgtggggactgggcccgcgccttgcacctcttctcgggcgtcccggcgccgcccgccaggctgtgcttcaacgcgggctgcgtgcacctgctggccggggaccccgaggccgcgctgcgggcatttgaccaagccgtgaccaaggacacctgcatggcggttggcttcttccagcgaggagtggccaacttccagctggcaaggttccaggaggctctgtctgacttctggctggccctggagcagctgaggggccacgctgccatcgactacacgcagctgggcctgcggttcaagctgcaagcctgggaggtgctacacaatgtggcgtcggcacagtgccagctggggctctggacagaggcggccagcagcctaagggaggccatgtccaagtggccggaggggtccctgaatggcctggactcagccctggaccaagtgcagagacggggctcactgccgccacggcaggtccccaggggcgaggtcttccggccccaccggtggcacctgaagcacttggagcccgtggatttcctgggcaaggccaaggtggtggcctctgccatccccgacgaccagggctggggcgtccgccctcagcagccacagggaccaggagcgaaccatgatgccaggtccctaatcatggactccccaagagctggcacccaccagggccccctcgatgcagagacagaggtcggtgctgaccgctgcacgtcgactgcctaccaggagcagaggccccaggtggagcaagttggcaaacaggctcctctctccccagggctgccggcaatgggggggcctggccccggcccctgtgaggaccccgcgggtgctgggggagcaggtgcagggggctccgagcccctggtgactgtcaccgtgcagtgcgccttcacagtggccctgagggcacgaagaggagccgacctgtccagcctgcgggcactgctgggccaagccctccctcaccaggcccagcttgggcaactcagttacctagccccaggtgaggacgggcactgggtccccatccccgaggaggagtcgctgcagagggcctggcaggacgcagctgcctgccccagggggctgcagctgcagtgcaggggagccgggggtcggccggtcctctaccaggtggtggcccagcacagctactccgcccaggggccagaggacctgggcttccgacagggggacacggtggacgtcctgtgtgaagagcccgatgtcccccttgcagtggaccaggcatggctggagggccactgtgacggccgcatcggcatcttccccaagtgcttcgtggtccccgccggccctcggatgtcaggagcccccggccgcctgccccgatcccagcagggagatcagccctaatgatgctgtgtccatgatgcttttaataaaaacaacccccactgca

SEQ ID NO: 157754 - DNA, 1464 bp, Homo sapiens
  Payload ID: 10913
  Gene Symbol: NOXA1
  Gene Name: NADPH oxidase activator 1
  Uniprot ID: Q86UR1
  ENST ID: ENST00000392815
  CDS Start-End: 136-1419
cggggttgcacctggcgcttggcgcccgcacctctgcccgcctcggagaccccgcagccccgcgccgccgcctggccccggccccggcccctccgcgggatcctggcccctcctcgagcgccgccaccggccgccatggcctctctgggggacctggtgcgcgcctggcacctgggcgcgcaggctgtggatcgtggggactgggcccgcgccttgcacctcttctcgggcgtcccggcgccgcccgccaggctgtgcttcaacgcgggctgcgtgcacctgctggccggggaccccgaggccgcgctgcgggcatttgaccaagccgtgaccaaggacacctgcatggcggttggcttcttccagcgaggagtggccaacttccagctggcaaggttccaggaggctctgtctgacttctggctggccctggagcagctgaggggccacgctgccatcgactacacgcagctgggcctgcggttcaagctgcaagcctgggaggtgctacacaatgtggcgtcggcacagtgccagctggggctctggacagaggcggccagcagcctaagggaggccatgtccaagtggccggaggggtccctgaatggcctggactcagccctggaccaagtgcagggaccaggagcgaaccatgatgccaggtccctaatcatggactccccaagagctggcacccaccagggccccctcgatgcagagacagaggtcggtgctgaccgctgcacgtcgactgcctaccaggagcagaggccccaggtggagcaagttggcaaacaggctcctctctccccagggctgccggcaatgggggggcctggccccggcccctgtgaggaccccgcgggtgctgggggagcaggtgcagggggctccgagcccctggtgactgtcaccgtgcagtgcgccttcacagtggccctgagggcacgaagaggagccgacctgtccagcctgcgggcactgctgggccaagccctccctcaccaggcccagcttgggcaactcagttacctagccccaggtgaggacgggcactgggtccccatccccgaggaggagtcgctgcagagggcctggcaggacgcagctgcctgccccagggggctgcagctgcagtgcaggggagccgggggtcggccggtcctctaccaggtggtggcccagcacagctactccgcccaggggccagaggacctgggcttccgacagggggacacggtggacgtcctgtgtgaagagcccgatgtcccccttgcagtggaccaggcatggctggagggccactgtgacggccgcatcggcatcttccccaagtgcttcgtggtccccgccggccctcggatgtcaggagcccccggccgcctgccccgatcccagcagggagatcagccctaatgatgctgtgtccatgatgcttttaataaaaacaacccccactgc

SEQ ID NO: 157755 - DNA, 1618 bp, Homo sapiens
  Payload ID: 10914
  Gene Symbol: NOXO1
  Gene Name: NADPH oxidase organizer 1
  Uniprot ID: Q8NFA2
  ENST ID: ENST00000354249
  CDS Start-End: 371-1483
cttctcctccctcctcctgtggccagaggcaggcaggagggccccaggcagcagtcccgcctacccttcgccccttcttcagtcttgcacgcctccagggctggaaagctcattcttcttcttcctcccagcagctctgcctggaagtcccccaatccctgtgctcctgcccccagatcgtgggcttgggggacagcaagaaagctgcaaaggactcagctggggcggctccacaaggaccccacaggcttgaggtgttgccaggattctatcccagggggttttctgggtcccccagagccctctcaagcacggggaggcagaagggtcctcgcccatttcaggaatctgcagcctggaagccacagccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaccctcaaggagaccttcccggtggaggcgggcctgctgcggagatctgaccgcgttctcccaaagcttctcgatgcaccactgttgggacgcgtggggcgcacgagccgcggcctggcgcgcctgcagctgttggaaacctattctcggaggctgctggcgactgcagagcgcgtggcacggagcccgacgatcactggcttcttcgcaccgcaacccctggacctggagcccgcgctgccacccggcagccgggtgatcctgcccaccccagaggagcagcctctttctcgcgctgcgggccgcctctccatccacagtctggaggctcagagcctgcgctgcctgcagcccttctgtacccaggacacgcgggataggccttttcaggcgcaggcccaggagagcctggacgtgctgctgcggcacccctcaggctggtggctggtggagaacgaagaccggcagaccgcctggtttccagcgccctacctggaggaggcggccccgggccaaggccgggagggaggcccgtccctagggagcagcggtccccagttctgtgcttcccgcgcctacgagagcagccgcgcagatgagctgtccgtgcccgcgggggcgcgcgtgcgcgtgttggaaacgtcagaccgcggctggtggctatgcaggtacggcgaccgggcgggcctactccccgcggtgctgctgcggccggaagggctgggcgctctcctgagcgggacggggttccgtggaggagacgacccggcgggtgaggcccggggcttccctgaaccctcccaggccaccgcccctccccccaccgtgcccacccgaccttcgccgggcgccatccagagccgctgctgcaccgtcacacgcagggccctggagcggcgcccacggcgccagggccgccctcgagggtgcgtggactctgtgccgcaccccacgacggagcagtgagcgcgaggatcccgatgaggggatggaccgcgccatcccagggctggggaggagcggggagggcggatctccctggccagcagggatgggagggggccatttgctgttcctctgagtaaagcttgttctgcatga

SEQ ID NO: 157756 - DNA, 1539 bp, Homo sapiens
  Payload ID: 10914
  Gene Symbol: NOXO1
  Gene Name: NADPH oxidase organizer 1
  Uniprot ID: Q8NFA2
  ENST ID: ENST00000356120
  CDS Start-End: 289-1404
tcttgcacgcctccagggctggaaagctcattcttcttcttcctcccagcagctctgcctggaagtcccccaatccctgtgctcctgcccccagatcgtgggcttgggggacagcaagaaagctgcaaaggactcagctggggcggctccacaaggaccccacaggcttgaggtgttgccaggattctatcccagggggttttctgggtcccccagagccctctcaagcacggggaggcagaagggtcctcgcccatttcaggaatctgcagcctggaagccacagccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaagaccctcaaggagaccttcccggtggaggcgggcctgctgcggagatctgaccgcgttctcccaaagcttctcgatgcaccactgttgggacgcgtggggcgcacgagccgcggcctggcgcgcctgcagctgttggaaacctattctcggaggctgctggcgactgcagagcgcgtggcacggagcccgacgatcactggcttcttcgcaccgcaacccctggacctggagcccgcgctgccacccggcagccgggtgatcctgcccaccccagaggagcagcctctttctcgcgctgcgggccgcctctccatccacagtctggaggctcagagcctgcgctgcctgcagcccttctgtacccaggacacgcgggataggccttttcaggcgcaggcccaggagagcctggacgtgctgctgcggcacccctcaggctggtggctggtggagaacgaagaccggcagaccgcctggtttccagcgccctacctggaggaggcggccccgggccaaggccgggagggaggcccgtccctagggagcagcggtccccagttctgtgcttcccgcgcctacgagagcagccgcgcagatgagctgtccgtgcccgcgggggcgcgcgtgcgcgtgttggaaacgtcagaccgcggctggtggctatgcaggtacggcgaccgggcgggcctactccccgcggtgctgctgcggccggaagggctgggcgctctcctgagcgggacggggttccgtggaggagacgacccggcgggtgaggcccggggcttccctgaaccctcccaggccaccgcccctccccccaccgtgcccacccgaccttcgccgggcgccatccagagccgctgctgcaccgtcacacgcagggccctggagcggcgcccacggcgccagggccgccctcgagggtgcgtggactctgtgccgcaccccacgacggagcagtgagcgcgaggatcccgatgaggggatggaccgcgccatcccagggctggggaggagcggggagggcggatctccctggccagcagggatgggagggggccatttgctgttcctctgagtaaagcttgttctgcatga

SEQ ID NO: 157757 - DNA, 1147 bp, Homo sapiens
  Payload ID: 10914
  Gene Symbol: NOXO1
  Gene Name: NADPH oxidase organizer 1
  Uniprot ID: Q8NFA2
  ENST ID: ENST00000397280
  CDS Start-End: 5-1135
agccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaagaccctcaaggagaccttcccggtggaggcgggcctgctgcggagatctgaccgcgttctcccaaagcttctcggtcaggccagcctggatgcaccactgttgggacgcgtggggcgcacgagccgcggcctggcgcgcctgcagctgttggaaacctattctcggaggctgctggcgactgcagagcgcgtggcacggagcccgacgatcactggcttcttcgcaccgcaacccctggacctggagcccgcgctgccacccggcagccgggtgatcctgcccaccccagaggagcagcctctttctcgcgctgcgggccgcctctccatccacagtctggaggctcagagcctgcgctgcctgcagcccttctgtacccaggacacgcgggataggccttttcaggcgcaggcccaggagagcctggacgtgctgctgcggcacccctcaggctggtggctggtggagaacgaagaccggcagaccgcctggtttccagcgccctacctggaggaggcggccccgggccaaggccgggagggaggcccgtccctagggagcagcggtccccagttctgtgcttcccgcgcctacgagagcagccgcgcagatgagctgtccgtgcccgcgggggcgcgcgtgcgcgtgttggaaacgtcagaccgcggctggtggctatgcaggtacggcgaccgggcgggcctactccccgcggtgctgctgcggccggaagggctgggcgctctcctgagcgggacggggttccgtggaggagacgacccggcgggtgaggcccggggcttccctgaaccctcccaggccaccgcccctccccccaccgtgcccacccgaccttcgccgggcgccatccagagccgctgctgcaccgtcacacgcagggccctggagcggcgcccacggcgccagggccgccctcgagggtgcgtggactctgtgccgcaccccacgacggagcagtgagcgcgaggatcc

SEQ ID NO: 157758 - DNA, 582 bp, Homo sapiens
  Payload ID: 10914
  Gene Symbol: NOXO1
  Gene Name: NADPH oxidase organizer 1
  ENST ID: ENST00000567471
  CDS Start-End: 355-582
agctcggcctccagatgagcctccagatggaggtctcaacatgttgcccagactggtctcgaactcctgagctcaagcaatccccctgcctcggcctcccaaagtacttggattacagctctgcctggaagtcccccaatccctgtgctcctgcccccagatcgtgggcttgggggacagcaagaaagctgcaaaggactcagctggggcggctccacaaggaccccacaggcttgaggtgttgccaggattctatcccagggggttttctgggtcccccagagccctctcaagcacggggaggcagaagggtcctcgcccatttcaggaatctgcagcctggaagccacagccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaagaccctcaaggagaccttcccggtggaggcgggcctgctgcggagatctgaccgcgttctcccaaagcttctcgatgca

SEQ ID NO: 157759 - DNA, 1144 bp, Homo sapiens
  Payload ID: 10914
  Gene Symbol: NOXO1
  Gene Name: NADPH oxidase organizer 1
  Uniprot ID: Q8NFA2
  ENST ID: ENST00000566005
  CDS Start-End: 5-1132
agccatggcaggcccccgatacccagtttcagtgcaaggggcagccctggtgcagatcaagaggctccaaacgtttgccttctctgtgcgctggtcagacggcagcgacaccttcgtgcgcaggagttgggacgaattcaggcagctcaagaccctcaaggagaccttcccggtggaggcgggcctgctgcggagatctgaccgcgttctcccaaagcttctcggtcaggccagcctggatgcaccactgttgggacgcgtggggcgcacgagccgcggcctggcgcgcctgcagctgttggaaacctattctcggaggctgctggcgactgcagagcgcgtggcacggagcccgacgatcactggcttcttcgcaccgcaacccctggacctggagcccgcgctgccacccggcagccgggtgatcctgcccaccccagaggagcagcctctttctcgcgctgcgggccgcctctccatccacagtctggaggctcagagcctgcgctgcctgcagcccttctgtacccaggacacgcgggataggccttttcaggcgcaggcccaggagagcctggacgtgctgctgcggcacccctcaggctggtggctggtggagaacgaagaccggcagaccgcctggtttccagcgccctacctggaggaggcggccccgggccaaggccgggagggaggcccgtccctagggagcagcggtccccagttctgtgcttcccgcgcctacgagagcagccgcgcagatgagctgtccgtgcccgcgggggcgcgcgtgcgcgtgttggaaacgtcagaccgcggctggtggctatgcaggtacggcgaccgggcgggcctactccccgcggtgctgctgcggccggaagggctgggcgctctcctgagcgggacggggttccgtggaggagacgacccggcgggtgaggcccggggcttccctgaaccctcccaggccaccgcccctccccccaccgtgcccacccgaccttcgccgggcgccatccagagccgctgctgcaccgtcacacgcagggccctggagcggcgcccacggcgccagggccgccctcgagggtgcgtggactctgtgccgcaccccacgacggagcagtgagcgcgaggatcc

SEQ ID NO: 157760 - DNA, 2804 bp, Homo sapiens
  Payload ID: 10915
  Gene Symbol: NOX5
  Gene Name: NADPH oxidase, EF-hand calcium binding domain 5
  Uniprot ID: Q96PH1
  ENST ID: ENST00000388866
  CDS Start-End: 42-2339
agcagtctttctgggacctgtgatctagaagacaggagaagatgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcattgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctacaaaaagtgagaagaatcatacagtgaacagtgttaccta

SEQ ID NO: 157761 - DNA, 2498 bp, Homo sapiens
  Payload ID: 10915
  Gene Symbol: NOX5
  Gene Name: NADPH oxidase, EF-hand calcium binding domain 5
  Uniprot ID: Q96PH1
  ENST ID: ENST00000448182
  CDS Start-End: 302-2461
gttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgaggtctcaatccattgcgcccaggctggtatgcagtcatgttgtatctggaattggtgggttcttggtctcactgacttcaagaatgaagccgcagaccctcgtgcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccat

SEQ ID NO: 157762 - DNA, 2277 bp, Homo sapiens
  Payload ID: 10915
  Gene Symbol: NOX5
  Gene Name: NADPH oxidase, EF-hand calcium binding domain 5
  Uniprot ID: Q96PH1
  ENST ID: ENST00000455873
  CDS Start-End: 56-2248
gagtgctacggacgacgcctatgaagcccttagtccttctagttgcgcttttgctatggccttcgtctgtgccggcttatccgacaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtc

SEQ ID NO: 157763 - DNA, 2289 bp, Homo sapiens
  Payload ID: 10915
  Gene Symbol: NOX5
  Gene Name: NADPH oxidase, EF-hand calcium binding domain 5
  Uniprot ID: Q96PH1
  ENST ID: ENST00000530406
  CDS Start-End: 39-2252
agtctttctgggacctgtgatctagaagacaggagaagatgaacacatctggagacccagcccagacgggccctgaaggctgtagaggcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccat

SEQ ID NO: 157764 - DNA, 8592 bp, Homo sapiens
  Payload ID: 10915
  Gene Symbol: NOX5
  Gene Name: NADPH oxidase, EF-hand calcium binding domain 5
  Uniprot ID: Q96PH1
  ENST ID: ENST00000260364
  CDS Start-End: 302-2545
gttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgaggtctcaatccattgcgcccaggctggtatgcagtcatgttgtatctggaattggtgggttcttggtctcactgacttcaagaatgaagccgcagaccctcgtgcaccatgagtgccgaggaggatgccaggtggctccggtgggtgactcagcagtttaagaccattgcaggagaagatggggagatcagcctgcaagaattcaaagcagctctgcatgtgaaagagtccttctttgcagagcgattctttgccctatttgactccgatagaagtggcaccatcaccctccaggagctgcaggaggcactgaccctgctcatccatggcagccccatggacaaactcaaattcctcttccaggtgtatgacatcgatgtgtgtgcacggcagggggcgtctgcaggtacagagtggggtgctggggcaggcccgcactgggcttcatccccactcgggacaggcagtggctccattgacccggatgagctgcgcactgtgctgcagtcgtgtctgcgcgagagcgccatctcgctgcctgacgagaagctggaccagctgacgctggcgctcttcgaatcggccgacgcggacggcaacggggccatcaccttcgaggagctccgggacgagctgcagcgcttccccggagtcatggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaaggtcactcatctcctcatcaagcggccccctttttttcactatagacctggtgactacttgtatctgaacatccccaccattgctcgctatgagtggcaccccttcaccatcagcagtgctcctgagcagaaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctagcctcacctctccaagctctgccccaagtccacaccatgggtctgcttcattgcattagtataaatgcccccacagggaccagcctcagatgacccacccaataagacaaagcctagggaccccctaatcctgctcaacagagagaacaggagaccccaaggggcagatgaacttcctctagaacccaggggaagggacagtgccttgttcagtctgctgtagattctggggtttctgtgaaagtgagggaaccagaggctggtcacgggagcttgggggtggggttcgagggggcagagggcaaccactcctccaaacattttccgacggagccttcccccacatccatggtcccaaacctgcccaatcatcacagtcatttggaagcttatttctccggcatcttataaaattgttcaaacctacaaaaagtgagaagaatcatacagtgaacagtgttacctactttctagactcctcagttaataatttgctctgtttatcacatattatccatcagttcctcctccctctttccatctgtcaatttatctgattttttggatgcattttcaagttaggtgcaaatatctcagcacaccttgctacttggaggagccttcttcaaatgcacattccttggtcccactaccagaaattctgattctgatgatctgggaatgaaacctgaaatatgtattttccaccaaatccatttgcatagggagaaataagcagcatctttccctgcccctccttgtgtctttgtctccccatctccctctctcctggcgcgtccctcagagcctctctgggctctgtatgctggcctcttccttctctctgtgtgctgagtcgcttgagaaacaggatggagacagcctctttgtgtgcctctctctgtcgtggaaaggccaagtgcctggggatgaagcgggctaagcctggaagctcagctcagccacactctggctgtgtggccctggaagcttccccatgtctgttattttcatctgtgaaataagctgatgccatccgtcagtcacagttgctgtgaggtgacatgagacgccaagtgctcaagacattccacctcagttcagctccttgctgctccaggctttcgtgcatctacatcatttctctttatcctggctccctctgtctctgttttccagcctctgtttgcgtctgtccctgtctgggcaggagggaacagcagaggcagcaaaggctctctcagcacatactgtggggaggagcggccctgggcagaggacagggtgggcctcacctcctccatctgagctggacatttccatctgtgccacaccatgagctcctgtgagccccacatttcctgggcatcctccaccttgcagtcagtcctgataggttctcttcttgacagtgtaaagcacccttccccaaggctgccatcatggggttggaaccaggcactttccaatgggattgtagctggcacctttcttttccatgggttggaagtccatggttgcaaagggggaggtaaagaagccggatcataacctggatgatgatgtcccttatctaaggtggggctgggatgcagcagtaggggtgggtgtgacctgcaggggatgagccagttgggtggatggaagaatgaaggtgggggaaagctctcttctgaaaggggcaataggaaggggatggtggaggaagacgctgaggcaggccctgggaaggggaaggcaaaacataccctgaggactgggacagagcaggatgggagtgaggatgtcatctttaagatgtgaggaggaacgggaagaagaatacgagaggaggagtggggcctgcagtcaaggagaggctaattcggtttgggtgggtggaaagcggggctcgtgcttgcaccaagcctccatctccctggactgggagtcagcaaggccaggagacctggtgttggggccttccaaccagatcgtgtttaatttccagcaagcctggggaggcacacaactcaccagggaaactcacacctggagttttaccagcctgaggccacacactcttggaacctctttccctctgttgagtctgtactttcccctcttcatcaggcttgggaaggcttggacaaaacgctctctggggcacagaaggaaactaaagagggtgttctgacttaaggttggaggatgtaaacaggctgtgccaaatcatttggaaacgtggcagaatctgtttagcacaggatgtctcacacatgcactcaatgcacacacacacatgcatgtcaccgttttggattctttcccatctctgtctacaccgccttaacacatttgagccctgccctcagtcctttgccctctcgtaacagatttccaccaggctcccacccgcatatacaaatagtcagctgttcgtttaggacttaataatatagtgggtgggagcaggtggaaggacttggacatacgattctaaaatccgtgaatgcccacatgtgtgacgaccatatgcccgtgtcctgaggttttctctccagacagattccagttgcccacgagagggcgctgcagaatcacggatctcaagcgggtttgtttcccaggaagtgagactggtccgtgagtggcagttaatcaaagggaaaggggctgggaagacaacgccctgttccaaagctccccactagaggcaaaacctccaggctccatctctgtgaagtcaagagacttcatgttcaaggtcagtttctctagctggcagcttctcactgccgctgccttcccccagaaactctaccctccccatacccagtgtccagttctgggctttcctcttttctgcttgcaacaaaatgtccatcggtgaggtcaagttgaactgaacaggcctggcttggggagagttcacaggtccaggttctgtctgcctcggtggacatgtcatcgaaggcagcaggaccacacatgtgagtgtacagcacgcatggtctgaccatctggatgtttcccagatgtgcagatgggcatcatcggccatcaacaggaaaatgcatccggatgactggctgacttttcttctctcaccagatgttgccaatgctgtagaaacatctgggcccacgacagataaggctgacacatgcaaagagaagagagaaggagcaaggccagttatcggcacgtgtgcccatcctcccccatgaagctgcaaactccccaaggccagacatggggacccaaagcctagcacagagtgtagaccagatgtcggttcctcccagggcaaggggttacttaaatggaattatccttacaaagagtcttttgcacctaattgtcacttgtaatttggggaacaaaagcacaaacacaagcccactgaaccactttgccaggtgccattgcactgttctgtgaggacagcgctgacggagacagcaggcattcctgaaatgaccaatcaggcagggccctcctggacgagcggcacaagtgcaggctattaatacactgagctggggcattcgtgggaggggagggggcatgggcaacatggagagtcaccaggctggcagacaaggttgaaggtagggagggatgaggaacattagccgagactggctctgggccaacctgttggagacacagtggacaaacctttgccctctgggaggcagggcactgagtcctacacttgcctctgccacagtctgctgtgtgaccttgggtgtatcatttgacctctctgagttctcactttcttattataaagtgaacagatcaagtatgtatgcgtttaagcacttgtcatttctaaaaggatacatgaaagtatatttatctgtgtgctctggggagtgggaatggagggatacaatgaaggaaaggattttgtgtttttgtttttgttttactttttgcccttctgtaaagtttaagtttttattaatattatagttttattttaaaaagaaaccccaaataggatgtcatgtaaaagaaaagaaaaaacaagtaccaagtgtttgatataatcctatttataacacagaaaataaatgacatatgtatatcatgtggggataaatagataaaaatacacggaaagacagttagaagccagccttaatctgtcttgggcccagacagcccttatctgttgggggcccagatgtgtctacagcattgttaacatctggtgaaaggagaaaagtcagccagccatcctgatgcgttttcttgctgatggccgatgatgcccaaatgctaagcagttcgcagtggttaactgtggaggaggcaaaggaggacttgaatgttttcctcttatctgtttcctgtatttgtgtgttacctgagtaaggtttcacttcctgtattactcatgtgatattttactttttaatttatgtacttttgtatggcttgtatctattttttaagagtaaaacaaaatgcagagattatctgcagtgttgtctaagatcctgaatattgatttggtatcaagtgaaagtatttcgggcctaagccaggggactggccctccccgtcaggggtcactccgtgggctcttcaataagggaggctcctatagtgcccattatcaatatgctgctggccctgaatggcctaagtattaaaataaaatgccctgtctaggcccaaaactagtccagaaggactgtggaggccgtgggcatacacgtgaaattgtgtgcacaggggctaagcccagcaccagcccagcctgggagttgagatgcctcagggcacactgtctgtgctaaacaaatactcatattaaccagccttcctgacagattgatgcatctttttatgatctgtctttacaatatgatgactctctccttttaaaaataagattaattcagacaagacatttattttatgaggaaattcatcccagggggaaaaatactcaacctgaatggcagaaatggctggaaagagacttgactctcaaggaagcttccagcctccaaccttagccacccagccatggccccaaaagggctgccctaatactactcagggacaaatgggccctcttaaactaccctagctgtgtgagtgtagcctgctggagaaacaaagaaagacaggtagtgagttttagtgtggcagggaagaaaaggatgcattttttggtaaaggaaaaaaaaattctgagatttacccaaatttggctggacatgagtttataaatacagattaagcttgtctttaaataaccctaaagaatgttcaagaacagtgaatgatttgtctctgtgtccccagtgactagaatagcgtcaccacctagtaggtgcttggcgtgtttcatgaatgtttccactgctatggtctgtttcagctggtgaccccatgaggtacccttggctcctctatctcccccatcttcctccttcagccaatcatcaagcctgtcaacatggcattctaaatgcttctcaagcacatttccttccccactggccctgccttggttcagtccttaaattgcctattgcctgaattggtgcatcagagacaggctggagaaaggaagaccagttagccagaaaggaagcttggaagaccacccagctaactggtcttcctttctccagcctggctctgatccatcctccacacactgctgtgggtctgactgcacaccttctttttggaggactctcctattatagccatcaaactcctgagtctgctacacaaggcccccccaacataagccctagatgaagatctgctaccattacagccagtattacctggcccttgcctacctctcaggtcttggcaatgtccaccttgctttttttactttaaatagcatcatttcgtgctcccccaggacactgtgcagcttcgcacctccaagcctttgcttctgcatcgcctgacacttggagcacccttctccactttcagattgagacttcggaacactttatcatcagcctatctgtaaagacttccttgctggtccctcccatcgcagaataaacagcctgc

SEQ ID NO: 157765 - DNA, 1565 bp, Homo sapiens
  Payload ID: 10915
  Gene Symbol: NOX5
  Gene Name: NADPH oxidase, EF-hand calcium binding domain 5
  ENST ID: ENST00000525143
  CDS Start-End: 1-885
atggagaacctgaccatcagcgctgcccactggctgacggcccccgccccccgcccacgcccgcgccggccgcgccagctgacccgcgcctactggcacaaccaccgcagccagctgttctgcctggccacctatgcaggcctccacgtgctgctcttcgggctggcggccagcgcgcaccgggacctcggcgccagcgtcatggtggccaagggctgcggccagtgcctcaacttcgactgcagcttcatcgcggtgctgatgctcagacgctgcctcacctggctgcgggccacgtggctggctcaagtcctaccactggaccagaacatccagttccaccagcttatgggctacgtggtagtggggctgtccctcgtgcacaccgtggctcacactgtgaactttgtactccaggctcaggcggaggccagccctttccagttctgggagctgctgctcaccacgaggcctggcattggctgggtacacggttcggcctccccgacaggtgtcgctctgctgctgctgctcctcctcatgttcatctgctccagttcctgcatccgcaggagtggccactttgaggtgttctattggactcacctgtcctacctcctcgtgtggcttctgctcatctttcatgggcccaacttctggaagtggctgctggtgcctggaatcttgtttttcctggagaaggccatcggactggcagtgtcccgcatggcagccgtgtgcatcatggaagtcaacctcctcccctccaagacactatctggctgcacattcggtcccaaggccagtggacaaacaggctgtatgagtccttcaaggcatcagacccactgggccgtggttctaagaggctgtcgaggagtgtgacaatgagaaagagtcaaaggtcgtccaagggctctgagatacttttggagaaacacaaattctgtaacatcaagtgctacatcgatgggccttatgggacccccacccgcaggatctttgcctctgagcatgccgtgctcatcggggcaggcatcggcatcaccccctttgcttccattctgcagagtatcatgtacaggcaccagaaaagaaagcatacttgccccagctgccagcactcctggatcgaaggtgtccaagacaacatgaagctccataaggtggactttatctggatcaacagagaccagcggtctttcgagtggtttgtgagcctgctgactaaactggagatggaccaggccgaggaggctcaatacggccgcttcctggagctgcatatgtacatgacatctgcactgggcaagaatgacatgaaggccattggcctgcagatggcccttgacctcctggccaacaaggagaagaaagactccatcacggggctgcagacgcgcacccagcctgggcggcctgactggagcaaggtgttccagaaagtggctgctgagaagaagggcaaggtgcaggtcttcttctgtggctccccagctctggccaaggtgctgaagggccattgtgagaagttcggcttcagatttttccaagagaatttctag

SEQ ID NO: 157766 - DNA, 8595 bp, Homo sapiens
  Payload ID: 10916
  Gene Symbol: NKD1
  Gene Name: naked cuticle homolog 1 (Drosophila)
  Uniprot ID: Q969G9
  ENST ID: ENST00000268459
  CDS Start-End: 225-1637
gccaatgggcgcgcggggaggcgcgggccgcggcggcgggctgggggctcggcgctcccgggcgtcagtcgggccgcggcgacggcggcaggagcgcgtcccggcgccgcctcgggctccgctcggctcgggggctgcttcgggaggaggagagccaagggaggcgccaggcccgcgggccgggcgcatggcttagggacgctcccggccgccgcagccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccttctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatcttttctggtgtgtataaatcagtggtttgcttccctggatgcttctggaacccagatgtgaccctgcttgtctccttttggggctggacggctctcagatgctttcatcagaggtccattctcgggttttggggtctgatggattttggagagaactgctggggtacagaaacttggtgggaaaaggggactgtggccagagttgggaccctggagcagcatcctctgcagagaaggattttgtctggccagagcctggagaaacctgaaaaagaaccagtcagctagccagggtctcagagaaaagcagattacacactcaaattgggtaatttgagcagagcttaataaaggcagtatttacaaagtgtgggctaagcctcccatgagagtgcagaaccctggggctagcagtgtggggcgctattcccacccctgggcctgagtggggaaggagttatctttagcagacagaggattgctggaggagtgagaggggcacctgaaggagctgtgacctttgcttaaaggatgcagccagtcatggggaccctccagggaaattaatatcctgacctgctttcctgccccccagccccctcaatccattggctgaggccgctggaagccaccgggccaagggagcttgttgatgtgggtcacacgggcatgttcccaggtcagagaggagagtggagagtgaatctagggagactcaagagggagaagtgactccagctaccttcctttctgccgttttgtctcccagctggcattctcttttccagagcctcgagtttgggtttaatgtagttagtaaggagttacttccaaaggtagtgggcttagttgtcaccgtattcttaattttattaatgactgatgtgcctgggattggattaatacattaatccttaggacagccccatgaggcagcttggtggcagctcaggaagcatgtctaaggctcagaagttcataactcccttgaggccgcacagagggcggagctggaattctggtctcccactcgatcccttcgccactggtgcagagcttaatcacggccatgggctgcccttgttttgggttgtgggtttctgttcagtgagaacgcaactcaatccaaagtgaatgaaaccaagttggaaggcagggagggaactggctttgagatgacagggtccaggatgtgaatgcagctgagactggttcttgtccctccctcttgtccctcggattgataacttgtactcaactacatgcttttgtcagggaaccctggctgctggccttctgggtcccctaaccataagaaaaaggaccttccgttagtgtaaagcccaaggcaggattctgcttggctgggcttcgatctggtacccatagctggaccaatcatgacatcccagatggggtcacgtggccaacctgccgcaagggggtggggtctgtaccggaagacaggaggggaggggtgcagatcggacaggaagtaatggcatcccaggccccgaattgctgcaaccctggaggccagcccggagttgagactactggttttagagcagttcctctgcctccctaagctccacacctgtcaggattctgttacttcttggtaactgggacttgcccaactttaaaaacattatttaaaaaaatagtaatgtgcacatgtaaaagattcaaatagtatatatacaaggtgtacagtaaaaagtaaacttccctccatcccaggcctgccagcatccctgatgccgactttctgggtgtggcctagggcccctcagtgtaatgtaggggttgtgagcacagactttggtgccagtttgctaggttcgaatcctgactccctctttgtagctctgtgcttcaattgaaatactgtgcctcagtttctcctttataaaggcagggatcatgagagtgcctgtcccttgtgagcactatgaaagtgttagctgttctttaccagaataaatgcatttctatatcttcccatatgcattttgttaatttttaaagtatttcaaacacaaagtttgaaacagaaaattgtgtaacattaactatgaacttaccacccagaatttacaaatgctgacattttgcaatatttatttcggatctatttttaagggggggaaccctgcagttactgcttaatcctcttcccaccccacccttttatttttacacaaggagcatagtgttcatacttatgctatttttttcagtaactgaatatatttggagatctccctccctaggtcatagagctctgcccccttctctctaacagctgctcagccttctgtgactagaggtgctgtcaccagcttgccccatcccctcctggtggtcataagggtcatctctcatcccaggctctggcgaacactgtgctgagagtccttgcatacagctctcccggtgcccacaggcaggaacacaggcgacagaaagtttccacgtggaactgcagagttcaagagcaagtgtgatttcaattttgatgagattgtacatgacctctaaaagaggttatactggccgggcacggtggctcacgcctgtaatctcaacactttgggagaccgaggtgggtggatcacctgaggtcaggagttcgagaccaacctgggcaacatggtgaaaccccgtttctactaaaaatacaaaaaattagctgggcatggtggtgcgtgcctgtaatctcagctactcgggaggccaaggcacgagaatcgcttgaacctgggaggcagagattgcagtgagctaagattgcaccactgtactccagcctgggcgacagagtgagactccatctcaaataaataaagaggttatactgaataatgaggaatcaaaggaagaagaagaaagagagaggaaggaaggttggaaggaaggaaggagggaaaattagaaggggaaaccatgattgctggtgaggttttgagcacattttcctgcaggctggtatgggtgagaggtttggtcttgtttgcaaatcttctgaaggccattccagaggagcagttgccactgccccatcccctgagctctgagcgtgggggttcccctggggagactcctggtgagaggatgccgatttctgctgatctgtcactgggtaccgaggactgggtgtgtttaaggcagacagccaggtgaggatcccagctactggggcctgctgtcatctcctgggagtacccgggggtcaggagcctaggggactcttgcacttcacatccagccatgctaattacactttttggcaaaggaaacagctaggagcagtttctttcactcctacagccccgttttctcagtgtttagacctcgaattattactgggctagagggaaggcagcctctgaagtgtggcaggaggaggggaagtctgcctgcatcttggtgtgtctgtcagatgccagcactaataacctggcttctgtgaggcctgtcagtgctctcaggaatgaaaggggacccctgagaggtgctcagtaccagcaggctgtgaatgctctctacccaccaccctcacctcctcgttaaagatggtgctacctgccacacagcagacatctggtcgctgcacacccgaaagaccccaaggcagtctgccccttgtccagccacacgccagcacccaccctcctggcccctgcctcggcctccccagaccagctgcacccagcccccaacacgcaccccttctccagatgtgtgcagggcctcattttgcagagcaaagacagatgtttcagccacacgctttattaacttctaaaacctgtgctcaggacactcttcaacagtcatgaaaagtttgatcacttgccacagtcaggacctttgtgtggggctctgatctgatgttcggtctcatcatctcccaaaccagcagtcgtttgtaccccaaccctctgctcaggggctcatacccccaaatgattttcctgatttatgtatttccctacaaagggctttctatacctagcatctgcctccagcatgagaagggggaataggtgagacccatttgccagtagcagacggggaccctggggagaaaatggcagagcctgttggagactccctgtctccagctgaccagccaatgggattcctcttccctccactgtctcccacaaagtagaagaatcctggtacatttagcccatgagcctggcacagatccctatctagacatgaggccctttagacatgactttggcattgaccagcctgttggcaatgggtcggggaggcagaggggatgctcacaccagtaattctcatcccctgaatgcttgggatcacctggggagagttcacaaaatactggtgcaggggtcccacctctgatgatgctgagtggtgggtctggggtgtggcccaggcatcatgatgtttcaggcccccaggtgacttcttaggcagcccagctaagcccctagagccttgcaatttcccccaaatgacctcagagggcccgatttgagggaaatgcctaacttcaggggccgtaagaatcccccagggagcatgtgaaatgcagataccaggcccacccccagagatgagctgaggtgggtcaggggtgaagtgcagggatcagtgtttttcacaagctccatacctccaggaaatggtgttgtggttgggcccgtagaaaacattctgagagtcctgttgcctgtgccttggtgcacgtggggtggaatcccagtggccctgccttgaggaggatgtgcattaacgtggtaggggagacagagacagctccacctgccccctgccccaccggggacctccaaaaacttcatggatgttagagcaagcagccatgctgcagcagaggatgaggctggcggatttagtaagagccctctgtgtttgggctgagttctttctctagttgccctgtcatctggcctctggataacccacctctcctccctcatcctaaaattacagatggcgaaagatggccacatttagtgagacccctaaggtcctccaactagggtgggtccacagtggcccctggtgcatggaccacacactctcttccctcctctggctcaggactacggtctgaaattagggagatatgaatgtctttcttgaaaacttctcttcccagtcttcccactttgcttgggggtccttggtcaaggccagctttggggactagggcttgttgcgactaccagctgtctcattttgctgtactgcaaactcaggcttggttccaagcttatgggggccctgtccttcccctagtagggtttgttttggggtcacatctggtcatacccttcagagagctcttccccagcctctacatcagggagagaggtaggtagggaggagcattcaaggattagaagaaggactaaagtacaacagccttggaggaactgccaggaactaagggcgagcactggagaaggcaacctgggaccccctgcgcttctgagcaggaagaccaagaccttcaggggccctaagcactgaaaacatcattcctcatccccaagccctggcatccccctgttcttctaaaataattcttttctaggtatttctgattgcaaaattctggatgggttcatccaagctgacctttgctgttttttcccttcccaacaaggcctcactttttggagccaccttagctggtgcctaggcagaggggcagtcagcagtggttatcaggatcctggctctatgggttgccttcctcctggtctgtaaagcccctgcaggcagggacttcttagatagctgcttccttagggcatggcatgtagtgggtggttaatgaatggaagagagggaatgagtgatcaagggagggaggagggagtggagtggagatttctcatcctttcctgttaatttatgacatcctcctgcctatgagtccttgactctggagttttacaaagcagtcacatttcaaataaaagtctgggaaagcaa

SEQ ID NO: 157767 - DNA, 1940 bp, Homo sapiens
  Payload ID: 10917
  Gene Symbol: NKD2
  Gene Name: naked cuticle homolog 2 (Drosophila)
  Uniprot ID: Q969F2
  ENST ID: ENST00000274150
  CDS Start-End: 97-1032
gctcccggcccatgcggcccccgcgggctcccggccccggcttcagaactcagccctgcacctgagcgcggggcccggcggggcgtggcggcggcgatggggaaactgcagtcgaagcacgccgccgccgcccgcaagcggagagagagcccggaaggggacagcttcgtggcgtccgcgtacgcgagcggccgcaaaggcgcggaggaagcggagcggcgcgcgcgggacaagcaggagctgcccaatggggaccccaaggaggggcctttccgggaggaccagtgtcccctacaggtggcactccccgctgagaaagctgagggccgcgagcacccgggacaactcctcagcgcagatgacggagagagggcagcaaaccgcgagggcccgcgaggaccgggcgggcagcgcctcaacattgacgcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtctcagctgtgcgagaagagaagctccgctcccaggacacacagtggggacaaggctagaggagtcggcctttgcagggagctgtggagccaggcaggtcacccacagtggccaggccccttcccttcagggctggtggccgtctgactgcagacttggctaacagactggcctcagggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacagcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattccaaaa

SEQ ID NO: 157768 - DNA, 2155 bp, Homo sapiens
  Payload ID: 10917
  Gene Symbol: NKD2
  Gene Name: naked cuticle homolog 2 (Drosophila)
  Uniprot ID: Q969F2
  ENST ID: ENST00000296849
  CDS Start-End: 230-1585
gccgctgtccccgcgccctgcgcccggtggccccccacctccgccccgcggccgtacctggcgccccctggctcccccggcccccgcgcggcgtggagccatcttccctcacctcctaccggcaccctagcttgctcccggcccatgcggcccccgcgggctcccggccccggcttcagaactcagccctgcacctgagcgcggggcccggcggggcgtggcggcggcgatggggaaactgcagtcgaagcacgccgccgccgcccgcaagcggagagagagcccggaaggggacagcttcgtggcgtccgcgtacgcgagcggccgcaaaggcgcggaggaagcggagcggcgcgcgcgggacaagcaggagctgcccaatggggaccccaaggaggggcctttccgggaggaccagtgtcccctacaggtggcactccccgctgagaaagctgagggccgcgagcacccgggacaactcctcagcgcagatgacggagagagggcagcaaaccgcgagggcccgcgaggaccgggcgggcagcgcctcaacattgacgcactccagtgcgatgtctcggtggaggaggacgaccgccaggagtggacgttcacgctctatgactttgacaactgcgggaaggtcaccagggaggacatgtccagcctcatgcacaccatctatgaggtcgtggatgcctcggtcaaccactcctcgggcagcagcaagaccctccgtgtgaagctaaccgtcagccctgagccctccagcaagaggaaggagggtcctcctgctggccaggaccgggagcccacccgttgcaggatggagggtgaactggcagaggagccaagggtggctgacaggaggttgtctgcacacgtcaggaggcccagtactgacccccagccctgctcggagcgggggccctactgcgtggacgagaacacggagcgcagaaaccactacctggacctcgccgggattgagaactacacgtccagattcggccctgggtcccctcctgtgcaagcaaagcaggagccccagggcagggcctcgcacctccaggcccggtcccgctcccaggagccagatacacatgccgtacaccaccgcaggtcacaggtgctggtggaacacgtcgtgccagcctcggagcctgctgcccgggccctggacacgcagccccggccgaaggggccggagaagcagttcctcaagtcccccaagggctccgggaagccgcctggggtgccagccagcagcaagtccgggaaagccttcagctactacctgccggccgtcctgccgccccaggcccctcaggacggccaccacctcccgcagcccccaccgccaccctacggccacaagcggtaccgccaaaagggcagggagggccactcgccactcaaggccccacacgctcagcctgccacagtggagcacgaggtggtgcgggacctgccgcccacgccagcaggagagggctacgcggtgccagtgatccagcggcacgagcaccaccaccaccacgagcaccaccaccaccaccaccaccaccacttccacccgtcctagcgccactgccaagcacacctcgctcccagcacaccacagcccgcgacctcagggcagggagcagagcagctgccggctgtgtgcccatggggagcccagcccccaccccccacctccgacagcaaacagcaactgactgcaggtgctggcatgatggaggtggtgcaccttggacacgtggacaaggcccaggcgccctctgctcttctgccctcgatgccacatggcggtgaacacatctgaagccactatgtttcctggctctaaggctcgtctgtgtaacccataaaacctgctttgattccaaaatgaggccctggagtgcgcaaggagtgcccggatgcttggggtgggtgttcctcccggggcttcaaggggtgactgctgtaggctgtcccagtgcgaggccgggagcgaatggaaaagctgaggctttgcctggcttgtgcatcatgaagtgagaggggacagggccggtggggggaagcagcttgtgcttagcagggagcatccgcggctccccgcaggaggccaagcagcagaaggcagcagtgctagaaagagaagtgc

SEQ ID NO: 157769 - DNA, 2155 bp, Homo sapiens; identical to SEQ ID NO: 157768
  Payload ID: 10917
  Gene Symbol: NKD2
  Gene Name: naked cuticle homolog 2 (Drosophila)
  Uniprot ID: Q969F2
  ENST ID: ENST00000616539
  CDS Start-End: 230-1585

SEQ ID NO: 157770 - DNA, 1940 bp, Homo sapiens; identical to SEQ ID NO: 157767
  Payload ID: 10917
  Gene Symbol: NKD2
  Gene Name: naked cuticle homolog 2 (Drosophila)
  Uniprot ID: Q969F2
  ENST ID: ENST00000610777
  CDS Start-End: 97-1032

SEQ ID NO: 157771 - DNA, 8761 bp, Homo sapiens
  Payload ID: 10918
  Gene Symbol: NHS
  Gene Name: Nance-Horan syndrome (congenital cataracts and dental anomalies)
  Uniprot ID: Q6T4R5
  ENST ID: ENST00000380060
  CDS Start-End: 339-5231
ggtggcgacggcgagcacagaaacgatggagttgagccagtcgaccctggttggaagcaagtgagaagagaccaggcgcacccctaaatttctgtgcggagcgcttgtcatcctccccagggaacggtgcacccaaaggaggactggctggactgatttgctagggagagggcggggaagaggaggcaaggtgagcagagaagccccctgcgtatccggactgccagatcgcgcttttgccggactcctgccccctccctgctcaggtgggcgcgcccggtctccagctcacaggggcgcttggaggagaccagaaagtcgccgcctggctgcgcgggatgcctttcgccaagcggatcgtggagccgcaatggctgtgcaggcagcggcgccctgcgcccggcccagcagtggacgcgagcggaggcagcgctgagccgccgccgcccttgcagccgccgggccggagggacctggacgaggtcgaggcgccagggccagaggagccagcccgcgccgtccctgcaccttcagggctgccaccgccgccgccgccactgcccgcgccggccgaccagactcagccgccgcacggagaggcgtccgtggctggcgaggagagcacggcggggatcccggaggcggcgcccgcagccggcgaggcgtcctcggcggcggcggcggcggccgtgctgctcatgctggacctatgcgcggtcagcaacgccgctctggcccgtgtcctccggcagctctcggacgtggcccggcacgcttgcagcctcttccaggagctcgagagcgacatccagctcacccaccgccgcgtctgggcgctgcagggcaagctcggcggcgtgcagcgcgtcctcagcacgcttgaccctaagcaggaggcagtgcccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtctttaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaattaaa

SEQ ID NO: 157772 - DNA, 8213 bp, Homo sapiens
  Payload ID: 10918
  Gene Symbol: NHS
  Gene Name: Nance-Horan syndrome (congenital cataracts and dental anomalies)
  Uniprot ID: Q6T4R5
  ENST ID: ENST00000398097
  CDS Start-End: 275-4699
ctgatttgccattcaagtgaaccctggagggattagcagccagcctagcacttgggtgagaccatctccccctccaggggggagtcctagatgcagcacagaggttctgtgaaaatctgccatcctccttgcagaaggttgccctctctcgccctccatcccccccgccgtgcttgctgacttaagcagatcagctttcagctctctggcattcagagacgtctttgcataaaagaaaaggcccttccttaaggagcagagcgggaatccaagcatggctctggcctgctgcatgcccaagaatgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtttaacagcacccgttcgccctcccccactgaatgttgccacatgaccccgtggagtagaaagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtctttaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaa

SEQ ID NO: 157773 - DNA, 8163 bp, Homo sapiens
  Payload ID: 10918
  Gene Symbol: NHS
  Gene Name: Nance-Horan syndrome (congenital cataracts and dental anomalies)
  ENST ID: ENST00000617601
  CDS Start-End: 293-4636
ctgatttgccattcaagtgaaccctggagggattagcagccagcctagcacttgggtgagaccatctccccctccaggggggagtcctagatgcagcacagaggttctgtgaaaatctgccatcctccttgcagaaggttgccctctctcgccctccatcccccccgccgtgcttgctgacttaagcagatcagctttcagctctctggcattcagagacgtctttgcataaaagaaaaggcccttccttaaggagcagagcgggaatccaagcatggctctggcctgctgcatgcccaagaatgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtctttaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaacgtgactgcaatt

SEQ ID NO: 157774 - DNA, 8860 bp, Homo sapiens
  Payload ID: 10918
  Gene Symbol: NHS
  Gene Name: Nance-Horan syndrome (congenital cataracts and dental anomalies)
  ENST ID: ENST00000615422
  CDS Start-End: 931-5346
ctggatctggatagtgtgtctggagggtaaagcagactgggccagttcatgccattcccgaggctgacaggctacccaggtgcttgtgaggtcctctttgcagccatttcttagtaaaaatcctcctggttcctaacatctgcttccagcagaatttctgtttaactcatggagagttccatcctaggatccctgtgtacatgaagaagatgagagtgagttaaatgctgtgtttgggggaaggaagccttccttccttgatctcttggatgagttgcaaaaactcatcttgcatctgcagtttccctcccttaatactcattacctctatgatggtttctttaatgcgtatgctcacccctgggtgaaaccaaggaagagcaatgctttgaaagatgacaggcaatggagccggtaggtgtagggcatgataaggataccttggggacgggaccacaagggacagaggcagggcaaggtataggccgaagttcaggtggacagcaggggcggcgtgcagaactacagctctgaggccctgcggccagaaggctggagctgaggcagcctttccattcatctctgaggctttcctccacatttttcagaaacaggacccccatctccacccccaagcaggctagccaggggcttgtcagtgttgatgagcgactgtgccaagggtgaggaatgaaggtacggagaggaaattagctagtcataggtagacggttggtgtcttggagcctcccgtgcctcggctcaggggcaaaagttgtccctatcagtatcataaatgccaaacctttctccggccttgagttagttcttaatgtgaatgcagtagtctggacttccactccacccagactttactcctgtcctcttccccaccccagggttggccaaaagcacaacttaaagccactgatggacaacgccctgtttcttgcagccgtctccaacctggacatagagagtaagctgagtgtgtactaccgcgccccgtggcaccagcagcgcaacatcttcctcccagccacaaggccaccctgcgtggaggagctgcaccgccacgcccggcagagcctgcaagccctgcgcagagaacaccggagccggagcgatcgccgagagcaaagagcagctgcccccctttccattgcagctcctccactgccagcctaccctccagctcacagccagaggaggcgtgagtttaaggaccgtcactttttaacgtttaacagcacccgttcgccctcccccactgaatgttgccacatgaccccgtggagtagaaagtcccatcccccagaggatgaagatacagatgtcatgttagggcagaggccgaaaaacccaatacacaatatcccttccacactggacaagcagaccaactggagcaaagcactacctctcccgacgccagaggagaagatgaaacaagatgcccaagtgatttcttcttgcattattcccatcaatgttactggagttggctttgacagagaggctagtatacgctgctctctggttcattcacaatcggtactacagcggagacgaaaattgaggaggaggaaaaccatctcgggtatccccagaagagttcaacaagaaatagattctgatgaatcaccagtggccagggaaaggaatgtgattgtgcacacaaacccagacccctccaacactgtcaataggatatccggaaccagggactctgagtgccaaaccgaggatattctgattgctgccccatccagaaggagaatcagagctcaaaggggtcaaagcattgcagcttccctttctcattctgctggcaacatttctgccctagcagacaaaggtgacaccatgtttactcctgcagtgagcagccgcacaagatctcggagccttccccgggaaggtaatagaggtggggatgctgagcccaaagttggcgctaaaccctcagcatatgaagagggagagtcttttgtgggtgaccatgaaagaacccctaatgatttcagtgaggctccaagcagcccgagtgcccaggaccaccagcctactttgggcctggcctgctctcaacatcttcacagcccccagcacaaattaagtgagaggggaaggtcacgtctgtcccgaatggctgctgactctggcagctgtgacatctcctccaactcagacacgtttgggagccccatccactgcatctccacggctggcgtcctccttagcagccacatggaccagaaagatgaccaccagtcatccagtggcaactggagtgggagcagctccacgtgcccctcgcagacctcagaaaccatccctcctgcagcttctcctccactcactggctcttcacactgtgactcggagttgtcactaaacacagcccctcatgccaatgaggatgccagtgttttcgtgacagagcaatacaatgaccacttggataaagtgagaggccatcgggcaaactcctttacctccactgttgcagacctgctggatgatcccaacaacagcaacacaagtgacagtgagtggaattacctacaccaccaccatgatgcctcctgccgccaggattttagtcctgagcgtcccaaggcagacagcctgggctgcccaagcttcacaagcatggccacttatgacagctttctggaaaagtctccatcagacaaagcggacactagctctcacttttcagtagacacggaaggatactatacctccatgcactttgactgtggtctcaaaggtaataagagctatgtctgtcactatgcagccctgggcccagagaatggccagggtgtaggggcttcccctggtcttccagattgtgcctggcaggactacttagaccacaagaggcagggaagaccaagcatctctttcaggaaaccaaaggcaaagccgaccccacctaaacgtagctcatcattgaggaagtctgatggaaacgcagatatttctgagaagaaagaaccaaagataagcagtggtcagcacctgcctcacagttccagggaaatgaagctgcctcttgatttcgccaacacgccttctcgaatggaaaacgccaatcttcccaccaagcaggaaccttcttggataaaccagagtgaacaaggcattaaggaacctcagttagatgcttcggatattccaccattcaaagatgaagttgccgaatccacacactatgcagacctctggctcctaaatgacttgaaaacaaatgatccttatagatctctatctaattcaagcaccgctacgggtaccacagtcattgaatgcatcaaatctccagagagctctgaatcccaaacatcacaatcagaatcaagagccaccaccccatctcttccttctgttgacaatgagtttaaactggcttcaccagaaaagctggctggcttggcatctccatcaagtggctattcaagccagtctgaaacgccaacatcctctttccctacagctttcttttcaggtccattgtctcccggaggtagcaaaagaaaacctaaagtcccagaaagaaaatcctcactacagcaaccctctttaaaagatggaactatatcactgagtaaagaccttgaacttccaattatacctcctacccatcttgatctaagtgctcttcataatgtcttgaacaaaccattccaccaccgtcatccactgcatgtttttactcataataagcagaacacagtaggagaaacactgaggtcgaatcctccaccgtcccttgcaattacaccaacgatcctgaaatctgttaaccttaggtccatcaacaagtctgaagaagttaagcaaaaagaagaaaacaatacagatctcccttatttagaggaaagcacactcacaacggctgccttgtctccaagtaagattaggccgcatacagcaaataaatcagtatctcgtcaatactccactgaagacaccatactgtcctttttagactcttctgcagttgagatgggaccagataaactacatttagaaaaaaactctacttttgatgtgaagaatcgctgcgatccagaaaccataacatcagctggtagcagtcttctagattcaaatgtcacaaaagaccaagtgcgtacagagactgagcctattccagaaaacacgccaaccaaaaactgtgcttttcccacagaaggatttcagagggtctctgctgcccgcccaaatgatttggatggtaaaataatacaatatggacctggtccagacgaaactctagaacaggtacagaaggcaccctctgcaggtctggaggaagttgcacaacctgaatctgtggatgtaatcacatctcagtcagactcaccaactagagcaacagatgtaagcaatcaatttaagcatcaatttgttatgagccgccaccatgacaaagtgcctggtactatcagctatgaatcggagataacatctgtaaattcattccctgaaaaatgttccaagcaggaaaatattgcttcaggtatttcagccaaaagtgcctctgataacagcaaagcagaggagacccaaggaaatgtggatgaggcttcattgaaagaatcatcaccgagtgatgactccatcatttcaccacttagtgaagactcccaagctgaagcagagggtgtgttcgtgtctccaaacaaacctcgaacaactgaggatttatttgcagtcattcacagatccaagaggaaagtacttggaagaaaagattccggggacatgtctgttcgaagcaaatcgagagctcccctcagcagtagcagcagcagcgccagttccatcacttcacccagcagtaatgtgacaacccccaacagccagaggtctcctggtctcatataccgaaatgccaaaaagtccaacacatccaatgaagagtttaagctgttactgctcaagaaaggcagtcgctcagattctagttaccgcatgtctgccactgagatcctgaagagccccatactgcccaaacctcctggggagctcacagcagagtcccctcagagcaccgatgatgcccatcaggggtcacaaggggctgaggcattgtccccactctctccatgctccccacgagttaatgcagaaggcttttcctcgaagagctttgccacctcagcatcagcaagggttggacgttctcgggcccctcctgcagccagcagcagccgctacagtgtccgctgccggctgtacaatacgcccatgcaggcaatctccgagggagagacggaaaattctgacgggagcccacatgacgaccgttcctcccagagttcaacatagactgcctgtaccaggctgcctggcaaaggccaaaacccttactcacatgaggatggaggaacagaacagaggacttgggaaaagtctcaacttgatggggtagcatcactgctaagcaatgaatgaatttctaaatacagtatgtgctgggtaaacagaaagtggtttagacattcttgattagtttccatattttaagtagctgcagtctttcatgtttttctttagcatagtttgatttacgcaatctccttccttgtgaaaatagaggatacaaaattgtctaattttcatgacacctagaaaacgttttcccagagctgcctattcagaaactaaagccctcactgtcattattctttaagaagatgaaattactctggatgtttggtatttttttacattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatgggagaggtagaacagagagagaattaagaagggatctgacttataaaagactagaatgtgattagagtgatagaacataccaatgttaccaagaaattgacaagctgctggctttaagcttatgcaagtggtagttgggaaagtaggaggtgtggaagagggtttgcattttggattaattcatgcaaaatgaaggaggaagcctggtctaagaagatactgtctttcaatagaaatgatttctaaactgctacagattaagaatagataatctgattgctgttgttttgtttgtttggaaagaaaaaaaatgtctggcttcttctactatttgttttcactaccaaactgtgttactaaatttcttgtcatccttgtatgtaaaatgggtgctgggggtggaggggtataagaggagggagagtcagagagagtgtgtatgggtgtgtgtgagtgtgagtgtgtgtgtacgcacacacactggggatagataagctacctggtaaagggtttgaacatttacaaaatgtcacactttttcttaaaagaaaaatattttggggtttgaataaaatggaccaccatttctcattggaacccattaattaagaaaaccagcatggtttgacaccacatgggaacatgaataaatctgtctcatgatttgaaaagtacaccttgcaaagttttaaaaataaagtttttaggcaaatgcgataagaaaccgtcatttccagtcacagtaggcgatctttcgtaatttcataaaagcagttcgtttgcagtatggcttttgtgtagttaggggttttttaagtgtgaagaaaggtatgtgggctttaaaagtgattctaaatcttgaatagaaaacacatgaattggctttaataaaaatgtcacctttttattattgacattaagtaatggtaccatatattttttaaaatacatattgacttgaattgtgaggcaataagataccttctatatgtaatgatcacagaactaacccttataatatagttttacttattttgtttactctaaaaatctatagcagagtttctctattttatatttcatagatttaaaaaacccaaataaagatggatttaaaattcactgtggaaaagagtattgagttacaaactgagaagaaaaagcaggaagttccctaataatctggaatattctacatggcttgattacatagcaaacaagaccaagatttagggctgtctttaacatcactgccgtcttgaagcagggtacacacgttaggtattgtgaagaacatcaatccgaacttttcttctgttgtttgcactgatgcgattttttgttcttttatgtttatacaacgtatctatgttgtgtaggggaaattttttcattttttaaaaattctactttggttttgttgttgttttgatttgtttttggctaagtagaggacatggactagttgtagcaaacagaacatgctgtttgctcttgccaaaggtcagtgagtgagtgcatttgctgcagtggtggcacgtagagaactagatggtaataaagatttaaaactatgaagaaggttacagtgtaactattttggtactagaaccagttcatgctggccgaaacgacaatggtttatggacttgcatccattttgtatttttgtaatatttgtaaatatgaactttttaaattgctgcaaagatggtttcttttgtaagatgttttcaacgtttacattcaatccaagcctttgtatattttagagctgtgcaacactttaagtcttgtatttatttttagtaaaaatggtgacagtttcattgtgaacccctctcaaaaaaaatgtatcagaaaagtttgattacctagaaagtgtgtatagaaactgcaaataaa

SEQ ID NO: 157775 - DNA, 5183 bp, Homo sapiens
  Payload ID: 10919
  Gene Symbol: NANOG
  Gene Name: Nanog homeobox
  Uniprot ID: Q9H9S0
  ENST ID: ENST00000229307
  CDS Start-End: 220-1137
ttcattataaatctagagactccaggattttaacgttctgctggactgagctggttgcctcatgttattatgcaggcaactcactttatcccaatttcttgatacttttccttctggaggtcctatttctctaacatcttccagaaaagtcttaaagctgccttaaccttttttccagtccacctcttaaattttttcctcctcttcctctatactaacatgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctttactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtgaagatgagtgaaactgatattactcaatttcagtctggacactggctgaatccttcctctcccctcctcccatccctcataggatttttcttgtttggaaaccacgtgttctggtttccatgatgcccatccagtcaatctcatggagggtggagtatggttggagcctaatcagcgaggtttctttttttttttttttcctattggatcttcctggagaaaatactttttttttttttttttttgaaacggagtcttgctctgtcgcccaggctggagtgcagtggcgcggtcttggctcactgcaagctccgtctcccgggttcacgccattctcctgcctcagcctcccgagcagctgggactacaggcgcccgccacctcgcccggctaatattttgtatttttagtagagacggggtttcactgtgttagccaggatggtctcgatctcctgaccttgtgatccacccgcctcggcctccctaacagctgggatttacaggcgtgagccaccgcgccctgcctagaaaagacattttaataaccttggctgccgtctctggctatagataagtagatctaatactagtttggatatctttagggtttagaatctaacctcaagaataagaaatacaagtacaaattggtgatgaagatgtattcgtattgtttgggattgggaggctttgcttattttttaaaaactattgaggtaaagggttaagctgtaacatacttaattgatttcttaccgtttttggctctgttttgctatatcccctaatttgttggttgtgctaatctttgtagaaagaggtctcgtatttgctgcatcgtaatgacatgagtactgctttagttggtttaagttcaaatgaatgaaacaactatttttcctttagttgattttaccctgatttcaccgagtgtttcaatgagtaaatatacagcttaaacataaatctttgttaaatttttggttggggtggagaaggaaattagctgaggacactgctatcttagaaatgcatagaaatagctgagcgtggtggcctatgcctgtagtcccagctatttgggaggctgaggcaggagaatcgcttgaacctggtaggtggaggttgtagtgagccaatatcacaccactgcactccagcttgggcgacaagagcaaaactcccatctcaaaaataaataaataaataagtaaataaatgaataataaataaatatgccagttttagaatgaatgaataataaatatgccagttttagaaaaaagggcacttacgtgcattgtacatgtgcatctacaaatgtaatgggttatttccgtgtatgaatctgtaattgatgctaacatttaaagtttcatcagaggcctatatgtaagtaaattctaaggctagttgaaacagatttatgttctcaccttaagagcagctacgcaggcatctgtgaattatactaataatcctttactgtccttttcccatcttgtgcctgccctaaatgtatctgatctgagagcacgtcccttcactctgaagcagcatgatgcaggttatcagagtggttttttccagtcttttctctcattatttccccaattgtccaatgttactaagactatccagtctaattccaagtgttttttttttgttttattttgtttttttttaagactggagtcttactctgttgcccaggctggagtgtagtggagcgatctcggctcaccgcaacctccgcctcccgagttcaagtgattctcctgcctcagcctcccaagtagctgggactacaggggtgagccaccatgcccagctaattgtatttttagtagagacagggtttcactatgttggccaggctggtcttgaactcctgacctcatgatccaccagccttggcctcccaaagtgttgggattacaggcgtgagccactgcgcctggcctatcgtttgtttttttagacagtctctctctattgcccaggctggagtgcagtggcacaatcttggctcactgcaacctccgcctcctgggttcgagcaattctcctgcgtcagcctcctaagtagctgggattacaggcacccaacattacacccggctaatttttggtatttttagtagagatggggtttcaccatgttggccagcctggtctcgaactcctgacctcaggtgatccacctgactcggcctcccaaagtggtgggattataggtgtgagccaccgtgtctgggcaatttttttttttttttttgagatggaacttcacttttgttactcaggctggagcacaatgatgcaatctctactcactgcaacctgcacctcccaggttcaagtgattctcttgcctcagcctttcgagtggctggtattacagggatttgccactatgcccagctaattctttgtatttagtagagatggggtttcaccgtattgaccaggctggtctcgaactcctgacctcaggtaatccaccctcctcggtctcccaaagtgctaggattacaggcatgagccacagtgcccagccttcttttttatttttttaagacgggcttattctgctgctcagactggggcttagtggcaccatttcacctcactgtagcctcgacttcccggattcaagcaatcctcctgcctgagtctctcaaatagcccagactataggtgcacaccaccatgccagctaacttttgtgtttttaggagagacggggtttccccatgttggcctggctagtctcaaactcctgagctcaagcagtctaccagccttggcctcccgaagtgctgagattacaggcatgagtcaccagcctagccctgtattatgttttctgaacttttttttttttaatcacccagtattaatcttcaacctcttggcaggtaagaatttagagatctatttggaataatctttaaagtaacaataataactacagtcaaaagcagtaagattagtgggccaggtgccgtggctcacacctgtaatcccagcacttcgggagaccaaggcaggtggatcacctgaggtcaggagttcaagtttagcatggccaatatggcgaaaccctgtctctactaaaaatacagaaatttgccagaggtcttggtttgcgcctgtaatctcagctacttggaaggcggaggcaggataatcacttgaacccgggaggttgcagtgaccccagataatgccaccccactccagcctgggcgacagagcgtcactgtctcaaaaataaacaaaaataataggagattaggcaaaaaggatagtacaaggctctctgtttaacatttcttcctttctctagaaaattttcctttcttttcccaaaaggaggtgtgtgttacttccaatgctatattttagtagctttaccatattttagtttttaaaattcattattttgatttctcagctttcattttcatttcagtttgtacctgaaggagagaagcatggattgaatttgcctgggttttccgaatttcataatataaatttaaaactcagaagtgggaggaatacaggccttgattagtgaatttcaagctcagttctcggggtgaaggacaaggttaattctactctgagtaattctaccgttcagaaaacctggtgtgtctacaggaaaaaatacaggctgtgactacaaacctaaaagtaaaggcaaacaactgccagacagaggcaggaaagtgggggagagcccttggtaaatattgcatgcctcctggggcccccatgggctttgactcaagggggagatgaagggaatttgttaaagaaagaagtcactgggacagacaaaagcttccggcacaggaagttagttcgactaaggataccgaaatgtaggaatttgaatgggttcctgggtgtgaggttgaagtgaaacttgattgaaaagaagctgctggtggtgagtctctccttaagctattcctggcttctgggtagttggtgtaaactctgtggtccttgaataaagtgtgcttgagaa

SEQ ID NO: 157776 - DNA, 870 bp, Homo sapiens
  Payload ID: 10919
  Gene Symbol: NANOG
  Gene Name: Nanog homeobox
  Uniprot ID: Q9H9S0
  ENST ID: ENST00000526286
  CDS Start-End: 1-870
atgagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcagttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtga

SEQ ID NO: 157777 - DNA, 836 bp, Homo sapiens
  Payload ID: 10919
  Gene Symbol: NANOG
  Gene Name: Nanog homeobox
  ENST ID: ENST00000541267
  CDS Start-End: 278-836
aaagcttctggtacctgccctttggagagctgcgggcaagctcagcctcgaaacacacacacccacacgagatgggcacggagtagtcttgaaagacatgacaaatcaccagacctgggaagaagctaaagagccagagggaaaaagccagaagtcgactacctgggaggagggatagacaagaaaccaaactaaaggaaactaaggtagtgtggatccagcttgtccccaaagcttgccttgctttgaagcatccgactgtaaagaatcttcacctatgcctgtgatttgtgggcctgaagaaaactatccatccttgcaaatgtcttctgctgagatgcctcacacggagactgtctctcctcttccttcctccatggatctgcttattcaggacagccctgattcttccaccagtcccaaaggcaaacaacccacttctgcagagaagagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctttactcttcctaccaccagggatgcctggtgaacccgactgggaaccttccaatgtggagcaaccagacctggaacaattcaacctggagcaaccagaccc

SEQ ID NO: 157778 - DNA, 870 bp, Homo sapiens
  Payload ID: 10920
  Gene Symbol: NANOGP8
  Gene Name: Nanog homeobox pseudogene 8
  ENST ID: ENST00000629403
  CDS Start-End: 1-870
atgagtgtggatccagcttgtccccaaagcttgccttgctttgaagaatccgactgtaaagaatcttcacctatgcctgtgatttgtgggcctgaagaaaactatccatccttgcaaatgtcttctgctgagatgcctcacacagagactgtctctcctcttccttcctccatggatctgcttattcaggacagccctgattcttccaccagtcccaaaggcaaacaacccacttctgcagagaatagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcacttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtga

SEQ ID NO: 157779 - DNA, 918 bp, Homo sapiens
  Payload ID: 10920
  Gene Symbol: NANOGP8
  Gene Name: Nanog homeobox pseudogene 8
  ENST ID: ENST00000528386
  CDS Start-End: 1-918
atgagtgtggatccagcttgtccccaaagcttgccttgctttgaagaatccgactgtaaagaatcttcacctatgcctgtgatttgtgggcctgaagaaaactatccatccttgcaaatgtcttctgctgagatgcctcacacagagactgtctctcctcttccttcctccatggatctgcttattcaggacagccctgattcttccaccagtcccaaaggcaaacaacccacttctgcagagaatagtgtcgcaaaaaaggaagacaaggtcccggtcaagaaacagaagaccagaactgtgttctcttccacccagctgtgtgtactcaatgatagatttcagagacagaaatacctcagcctccagcagatgcaagaactctccaacatcctgaacctcagctacaaacaggtgaagacctggttccagaaccagagaatgaaatctaagaggtggcagaaaaacaactggccgaagaatagcaatggtgtgacgcagaaggcctcagcacctacctaccccagcctctactcttcctaccaccagggatgcctggtgaacccgactgggaaccttccaatgtggagcaaccagacctggaacaattcaacctggagcaaccagacccagaacatccagtcctggagcaaccactcctggaacactcagacctggtgcacccaatcctggaacaatcaggcctggaacagtcccttctataactgtggagaggaatctctgcagtcctgcatgcacttccagccaaattctcctgccagtgacttggaggctgccttggaagctgctggggaaggccttaatgtaatacagcagaccactaggtattttagtactccacaaaccatggatttattcctaaactactccatgaacatgcaacctgaagacgtgtga

SEQ ID NO: 157780 - DNA, 907 bp, Homo sapiens
  Payload ID: 10921
  Gene Symbol: NANOGNB
  Gene Name: NANOG neighbor homeobox
  Uniprot ID: Q7Z5D8
  ENST ID: ENST00000382119
  CDS Start-End: 71-637
atctaccttatctggtcggtcatctctgtaacctccctaccaaggactaattggtctttaaaactcctcaatgcaccgggcgcggtggctcacgcctgtaatcccagcactttgggaggccgaggcgggcagatcacgaggtcaggaaatcgagaccatcttggctaacaagaaacaatcagctatgccttgggatcaagatccagaacaatcaactggaaattacagtgaagatgaacaaaatggaaagcagaaatggagagaagaaggagaagcaggcagaaagagagaacgagaaaaagaagaaaaaaacgaaaaggagctgcaagatgaacaggaaaacaaaaggaaaagggaaaatgagaaacagaaacagtatcccgagaaaagattagtcagcaaatccctcatgcatactctctgggcaaagtttaagttaaacaggtgccccactatacaagagagtctatcactgtcatttgaatttgacatgacacataaacagataagtcaatggttttgtaaaacgaggaagaaatataataaagaaatgtccaagagaaagcataagaaaaaacatatgagatggagatctctgtgttgccaaggctggtctcgaactcctgccctcaagtgatcttcctattttggcctccagaaatgctgtgattacaagcatgagccatcgcactggctaagacattttacatgacaccattctcaccaataaatggagttctgaaaggataaacaagaaaacattaacagtcgttgattccgtggagtagaactaaatgaggggtatgcaaaggagtttttatgtgttttatttttaccctactgtagatttaaagtttttataatggatgttaattgattttatttaagaaaaaaaatcgagtcaagg

SEQ ID NO: 157781 - DNA, 1108 bp, Homo sapiens
  Payload ID: 10922
  Gene Symbol: NANOS1
  Gene Name: nanos homolog 1 (Drosophila)
  ENST ID: ENST00000340087
  CDS Start-End: 1-255
cccgagctgcaggtgtgcgtgttctgccggaacaacaaggaggcgatggcgctctacaccacccatatcctcaagggccccgacgggcgagtgctgtgtcccgtgctgcgccgctacacgtgtcccctgtgcggcgccagcggcgacaacgcgcacaccatcaagtactgcccgctctccaaagtgccgccgccgcccgcccgcccgccgccccgcagcgccagggacggcccgcctggcaagaagctgcgctgaaggcccgggctcccggccgcccagggtcgccgccgcccctcgcaccgctaggtctgcgcaccatctcgcccccgccgtggggaggcgtgcggctcagcggtcggctcgacatgggacgtcgtcctggtggtttttgaaaagcagccgaccgtgtggagtacttccgtgctgaacgattgggactagacgctgaaatccccatttgtcttcagtttctagtttgcacatccagaacggcgaaggctgggtgtgtattccactaactgaaatatggcaacttagaggcgctgtttatttactgtatacgtcgacctattttagatgcgcatcagtatgaaattgtctcaatcttggatgtttcattttatgaatggaggcactttactaggtctagaatatttttttaaaagcctctgaactgagcttaaaactggcgattttatgaaatgtcggcaaaatgactattttattgtttgaagcgagttaatattctcagttgtctttaaaaatcagttactctaattccaggtgaagcaagccgctggtagcatcacccttatgagaagtgaaggttttgtaaactttccagtattaatttgggcgggtattccccgcttgtggcttgtttctgtcctagctggaggtgtaaaatgcacaatgtgtagcaggtagaatacagctccttatcgttctatgtaccaggtattttattactgaactagcaactagccttttccacctttaaaagttgtgccaagtcataatcatattgtgtataacttggaaatggtgctgtttaaaaaaattgtgtatttatacagtaacagtatgaattcattaatctcacctgtaa

SEQ ID NO: 157782 - DNA, 4017 bp, Homo sapiens
  Payload ID: 10922
  Gene Symbol: NANOS1
  Gene Name: nanos homolog 1 (Drosophila)
  Uniprot ID: Q8WY41
  ENST ID: ENST00000425699
  CDS Start-End: 87-965
ggcaggccggcgggcaggctcggcgtgtcccttccgtccggcccgcgccggcggcggggaggcggcgcgcggcccgcagcccgcccatggaggctttcccctgggcgccccgctcgccccgccgcggccgcgcccccccgcccatggcgctcgtgcccagcgcccgctacgtgagcgccccgggcccggcgcacccgcagcccttcagctcctggaacgactacctggggctcgccacgctcatcaccaaagcggtggacggcgagccgcgcttcggctgcgcccgcggtgggaacggcggcggcggctccccgccctcctcctcctcgtcgtcctgctgctccccccacacgggggccgggcctggggcgctggggccggcgctggggccgcccgactacgacgaggacgacgacgacgacagcgacgagccggggtcccggggccgctacctggggagcgcgctggaattgcgcgcgctggagctgtgcgcgggccccgccgaggccgggctgctggaggagcgcttcgccgagctgagcccgttcgcgggtcgtgccgccgccgtgctgctgggctgcgcgcccgccgccgccgccgccgccaccaccaccagcgaggcgacgccgcgcgaggagcgggccccggcgtgggcggccgagccccggctgcacgcggcctccggggcggcggccgcccggctgctgaagcccgagctgcaggtgtgcgtgttctgccggaacaacaaggaggcgatggcgctctacaccacccatatcctcaagggccccgacgggcgagtgctgtgtcccgtgctgcgccgctacacgtgtcccctgtgcggcgccagcggcgacaacgcgcacaccatcaagtactgcccgctctccaaagtgccgccgccgcccgcccgcccgccgccccgcagcgccagggacggcccgcctggcaagaagctgcgctgaaggcccgggctcccggccgcccagggtcgccgccgcccctcgcaccgctaggtctgcgcaccatctcgcccccgccgtggggaggcgtgcggctcagcggtcggctcgacatgggacgtcgtcctggtggtttttgaaaagcagccgaccgtgtggagtacttccgtgctgaacgattgggactagacgctgaaatccccatttgtcttcagtttctagtttgcacatccagaacggcgaaggctgggtgtgtattccactaactgaaatatggcaacttagaggcgctgtttatttactgtatacgtcgacctattttagatgcgcatcagtatgaaattgtctcaatcttggatgtttcattttatgaatggaggcactttactaggtctagaatatttttttaaaagcctctgaactgagcttaaaactggcgattttatgaaatgtcggcaaaatgactattttattgtttgaagcgagttaatattctcagttgtctttaaaaatcagttactctaattccaggtgaagcaagccgctggtagcatcacccttatgagaagtgaaggttttgtaaactttccagtattaatttgggcgggtattccccgcttgtggcttgtttctgtcctagctggaggtgtaaaatgcacaatgtgtagcaggtagaatacagctccttatcgttctatgtaccaggtattttattactgaactagcaactagccttttccacctttaaaagttgtgccaagtcataatcatattgtgtataacttggaaatggtgctgtttaaaaaaattgtgtatttatacagtaacagtatgaattcattaatctcacctgtaactttcctacttggcattttctctacacactcaccctcttccagttctttaaaaacgtttatgatattaagatcaaagggaggaagggaagacagcagtattaattcaccctagattactcaatttcagggttcctagtggaggaaagcccattccagctgttgcctgtcaaacaaatagaagatggatctctagctctgagctattcgtgtattaactcgtattcaagaaggttccaccgtgggctgcgtctgactttaatacaggcagtgctcaaactagaataagcactaattaaaggaattgttgggggtccttcatgtgttcccactcctactggaagacccatgtcggtttccggaaccccaccagtttacccataagcaagactaaacctgatccttgggcaaaagttcctaacccctactttaccctcccaccctcacttttaaatccaccatactgaatgccacactatggaatgcagctacctgccaagcaaggcaatagaaggcaaaaaatggaagtgaattaagatgaactcatctgaaatacacaaatgcattactatctgaagataccagcaagagtttagtctacgtgtataaggctcccagtaggatttagctaggctactagaagttagactgctttcgcattaaacagctaacttcatccacagcaaattgactcaatcaggaaccttcatttgaaggtgtgttagaggatggggtaaatacccgatagctgtctttttggtgaaagaaaaggtgcatttcaagaacttggggggcaggaggaaagcacaatgtttcttagccaggaaagacaaataatccaacgctgctagtcttaaccccagaccagagagaactgcagatctgactgggcctaaattaagtagcttaatgaaaccatgtaattacttgttctcctttcttttgctatagaaaatctaccagtttaaatgagcttcaccttctgggtgaagtttctaaggtcaacatgaatcctcttacctctctcactgctcgtgttctgccttttcaaaaggaccactatgaacagatcagcgcattctctaggccaaaagggctagccaggtggcaagatcaatttagctactttgtattttcagagtcaaattacagacggtttccaaaggtcttgagcatggggctttggcatagcctcaatatatgggagtcactgtgatgagatgtgcctaatgttaatttgatattctgacattgctattttaccagaactaagaacatattgagctggagcttcttgagggcaggagagtattggaaaaggaatccagaagaccctctccactactcaggcagccactattcatctatttttaaagtaccccattttcaggccgggtgtggtggctcatgcctgtaatcccagcactttgggaggcgaggcgggggtggatcacaaggtcaggagaccagcctggccaacatggcgaagccccgtctctactaaaaatacaaaaattagccgggtggtgtggtgggcgcctgtaatcccagctcctcaggaggctgaggcaggagaattgcttgaaaccaggaggcggaggttgcagtgagcccagatcacgccactgcactccagcctgagcaacagagcgactctgtctccaaaaaagaaaaaaagtaccccatgttcagcccctgtgccaaatttgcctaggttttccagctgacaatgaatactgggagttaaaacgcagagtattactatagttaattttctagggttctcttatgaaaagtatatgtaaacacattcatttaaaaatccttggaactcaatgtggaactttaaacattttgcaaaattacatttagagaaacccaatttttcaaagtttaagaaatatacaaagtatgacaaaattatcttcataagaacatgctgcatacttgcctagtagcaaaacaatacagggaagagtcaaaagggcttctccaactgtagaggtacagattgtcttaacctgttcttttctgtacagacttaaaatttctagtggcttttatttttctttgtattttaattttcctacaaagtcctttttggaagttgcagaattattagctttgatgagaacaacttttgtcatagatttgatttattaaaccaaaattatacatattaaaattatatcacaaatata

SEQ ID NO: 157783 - DNA, 1657 bp, Homo sapiens
  Payload ID: 10923
  Gene Symbol: NANOS2
  Gene Name: nanos homolog 2 (Drosophila)
  Uniprot ID: P60321
  ENST ID: ENST00000341294
  CDS Start-End: 178-594
ggcagggagtgagccctttaaatcctaagctccacctttacttagaagagtctctgggcgttataaaaggggatgcagctcccttctgctctgggaaacgcctgctgctcttgcccttgcccacgggcccccagccccagcccctctcctgtggcccaccacccctgctttggtgccatgcagctgccacccttcgacatgtggaaggactacttcaacctgagccaggtggtgtgggcgctgatcgcaagtcggggtcaaaggctggagacccaagagattgaggagccaagtcccgggcctccgctggggcaggatcaggggctgggggcgccaggggccaacgggggcctggggaccctgtgcaacttctgcaagcacaacggggagtcccgccacgtctactcctcacaccagctgaagacaccggatggcgtggtggtgtgtcccatcctgaggcactacgtgtgtcccgtgtgcggggccaccggtgaccaggcccatacgctcaagtactgcccgcttaacggtggccagcagtccctctaccgccgcagcgggcgcaactcggccggacgcagggtcaagcgctgagcatcgtgagatgctcaccacccgcacccctgaccctcctggtccatcccacccaagtccctaaactctctcttccagtcacccagccctttggaatttctggcccccagaactccaccctggctggatcctgaaacagtggaggctgctgggagccaggccagccccgcccccttggacctgtcagccctcggagctctggcctgtgggcgttggcctgagggtccttggtgccgcgggaacccttcctgcacggccctgtagcgccctctgggccccggttcatggatcttttgtcctcgtggggcctgctggtgactggagccctgccccttcgacttctctgttccttgtggagttcttggatttttgaacctccaggattccacggtgctgtcccaagccagcccttaggagatactgaacaaggctggctgagaagtgcctactcaagaacttcaagatgggatgtcgacttaagaccagccttctccatcttcagcctcctgcagaaccacggtgtcatcgtggaccacgcctgttcattccttccctgacctcagtacccatccgtcaggagcggagtaggactctggagagcaccgtatcactggagggcaccgtgtcttcgcaggctcacctgtggatggagagccgtggggtgagctgacacctttcaatgccccctggttgttcttccccttgttcagcccattgcacccggtacctgcccccatccccaaatcaccgatgggtcctttcccccagcgagaagcatatctctcgaccacctcccgtccgaccccccaaatcgtgatagttgactaaaggacatttttttttcctcctgtgtttttcaacctccaacgttcaagtcaaggaaccgccgataagaagggggtttgagtacccggatgggaatggcaatggcctagcttttattttaggggcaaagagaagaagggcccccgtcagattttaagttgttcagtttttggcacagggtcgggaccctgagtattgagctctggtgaataaaaaggttttctagtcgtctttgaaa

SEQ ID NO: 157784 - DNA, 581 bp, Homo sapiens
  Payload ID: 10924
  Gene Symbol: NANOS3
  Gene Name: nanos homolog 3 (Drosophila)
  Uniprot ID: P60323
  ENST ID: ENST00000339133
  CDS Start-End: 3-581
ctatggggacctttgacctgtggacagattacctgggtttggcacacctggttagggctctgagtgggaaagagggtcctgaaaccaggctgagcccccagccagagccagagccaatgctggagccggtgtcagccctggagccgatgccagcgccggagtcggtgccagtgccgggacccaaggatcagaagcgcagcctggagtcctcgccagctcccgaacgcctgtgctctttctgcaaacacaacggcgagtcccgggccatctaccagtcccacgtgctgaaggacgaggctggcagggtgctgtgtcccatcctgcgggactacgtgtgtccccagtgcggcgccacacgtgagcgcgcccacacccgacgcttctgcccacttactggccagggctacacctccgtctacagccacaccacccgaaactcggcaggcaagaagctggtccggcctgacaaggcgaagacacaggacacaggccaccgccgaggaggaggaggaggagcaggtttcagaggtgccgggaagtctgagccttcgccctcctgctctccctccatgtccacctag

SEQ ID NO: 157785 - DNA, 769 bp, Homo sapiens
  Payload ID: 10924
  Gene Symbol: NANOS3
  Gene Name: nanos homolog 3 (Drosophila)
  Uniprot ID: P60323
  ENST ID: ENST00000397555
  CDS Start-End: 1-522
atggggacctttgacctgtggacagattacctgggtttggcacacctggttagggctctgagtgggaaagagggtcctgaaaccaggctgagcccccagccagagccagagccaatgctggagccggatcagaagcgcagcctggagtcctcgccagctcccgaacgcctgtgctctttctgcaaacacaacggcgagtcccgggccatctaccagtcccacgtgctgaaggacgaggctggcagggtgctgtgtcccatcctgcgggactacgtgtgtccccagtgcggcgccacacgtgagcgcgcccacacccgacgcttctgcccacttactggccagggctacacctccgtctacagccacaccacccgaaactcggcaggcaagaagctggtccggcctgacaaggcgaagacacaggacacaggccaccgccgaggaggaggaggaggagcaggtttcagaggtgccgggaagtctgagccttcgccctcctgctctccctccatgtccacctaggaggctgcctacacctgggcaagggcacccgggctcggctggatttccaggaagacccaccctatgacgactgcccccactcccagaccctccccccagcctgggattgagccctggggatgacccggggttggcaagggaagagctgaaatcgccctgtccttggggaccccaccctttgtgccatctgccgtttccctagtgctgggcatccagtcagccctcaataaatgcttatgaatggatc

SEQ ID NO: 157786 - DNA, 1548 bp, Homo sapiens
  Payload ID: 10925
  Gene Symbol: NAPSA
  Gene Name: napsin A aspartic peptidase
  Uniprot ID: O96009
  ENST ID: ENST00000253719
  CDS Start-End: 210-1472
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctgtgctgccatcctggatacgggcacgtccctcatcacaggacccactgaggagatccgggccctgcatgcagccattgggggaatccccttgctggctggggagtacatcatcctgtgctcggaaatcccaaagctccccgcagtctccttccttcttgggggggtctggtttaacctcacggcccatgattacgtcatccagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttccattga

SEQ ID NO: 157787 - DNA, 810 bp, Homo sapiens
  Payload ID: 10925
  Gene Symbol: NAPSA
  Gene Name: napsin A aspartic peptidase
  ENST ID: ENST00000598915
  CDS Start-End: 5-810
agcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttcttcagtgtgccctgctcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatccacatggagcgtgtgaaggtgggcccagggctgactctctgtgccaagggctg

SEQ ID NO: 157788 - DNA, 867 bp, Homo sapiens
  Payload ID: 10925
  Gene Symbol: NAPSA
  Gene Name: napsin A aspartic peptidase
  ENST ID: ENST00000599233
  CDS Start-End: 210-524
caggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggagagaaccagcagagctccccaagttgggggccccatcccctggggacaagcccatcttcgtacctctctcgaactacagggatggttacaccaccgatttgatcccaaagcctctagctccttccaggccaatgggaccaagtttgccattcaatatggaactgggcgggtagatggaatcctgagcgaggacaagctgactattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacagggaccctgaagagcctgatggaggagagctggtcctggggggctcggacccggcacactacatcccacccctcaccttcgtgccagtcacggtccctgcctactggcagatcca

SEQ ID NO: 157789 - DNA, 3691 bp, Homo sapiens
  Payload ID: 10926
  Gene Symbol: NRD1
  Gene Name: nardilysin (N-arginine dibasic convertase)
  Uniprot ID: O43847
  ENST ID: ENST00000352171
  CDS Start-End: 191-3646
agtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaat

SEQ ID NO: 157790 - DNA, 3895 bp, Homo sapiens
  Payload ID: 10926
  Gene Symbol: NRD1
  Gene Name: nardilysin (N-arginine dibasic convertase)
  ENST ID: ENST00000354831
  CDS Start-End: 191-3850
agtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaat

SEQ ID NO: 157791 - DNA, 1660 bp, Homo sapiens
  Payload ID: 10926
  Gene Symbol: NRD1
  Gene Name: nardilysin (N-arginine dibasic convertase)
  ENST ID: ENST00000440943
  CDS Start-End: 1-1615
gaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttggttctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtattttaaaat

SEQ ID NO: 157792 - DNA, 3819 bp, Homo sapiens
  Payload ID: 10926
  Gene Symbol: NRD1
  Gene Name: nardilysin (N-arginine dibasic convertase)
  ENST ID: ENST00000544028
  CDS Start-End: 323-3172
actttgggtttcgaaatgttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccaggtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtatttt

SEQ ID NO: 157793 - DNA, 3417 bp, Homo sapiens
  Payload ID: 10926
  Gene Symbol: NRD1
  Gene Name: nardilysin (N-arginine dibasic convertase)
  ENST ID: ENST00000539524
  CDS Start-End: 114-3377
tttgaatacagtcgctaaagcaagaatgaaggtttctttgaggaacgcagcctgaatgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataaataaactgcagtcacgttggcctgaagcaatgtgtatttt

SEQ ID NO: 157794 - DNA, 3574 bp, Homo sapiens
  Payload ID: 10926
  Gene Symbol: NRD1
  Gene Name: nardilysin (N-arginine dibasic convertase)
  ENST ID: ENST00000615102
  CDS Start-End: 96-3542
ctgcggcagcaccagggccggccgccaccgcctctagaacgcggaggaggtgggtcctgggaagcgggatgtccatcgctccagcttggtggtgaatgctgaggagagtcactgttgctgcagtctgtgccacccggaggaagttgtgtgaggccgggcgggagctcgcggcgctctggggaatcgaaacgcggggtcggtgcgaagactctgctgctgccagaccctttcctattctggccatgcctggaaggaacaaggcgaagtctacctgcagctgccctgacctgcagcccaatggacaggatctgggcgagaacagccgggttgcccgtctaggagcggatgaatctgaggaagagggacggagggggtctctcagtaatgctggggaccctgagatcgtcaagtctcccagcgaccccaagcaataccgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcaattgtatcatccccattactgatatcagggctttcacaacaacactcaaccttctcccctaccataaaatagtcaaataaataaactgcagtcacgttggcctg

SEQ ID NO: 157795 - DNA, 2690 bp, Homo sapiens
  Payload ID: 10927
  Gene Symbol: NACA
  Gene Name: nascent polypeptide-associated complex alpha subunit
  Uniprot ID: Q13765
  ENST ID: ENST00000356769
  CDS Start-End: 1938-2585
tcccagctactctggaggctgagacgagaatcgcttgaacccgggaggccgaggttgcagtaagccgagatcgcgccactgcactccagcctgggcgacagagcgagactccgcctcaaaaaataaataaatgttgactggtttagctaattcaggtacagcaaatatttgttgagttcttttgtagggctgtgggaagatatgggaggcttttcattaacacaacactgattttacattctacttttcaaaaatacagttgtacaaagcatggtttaaggtggggtcccagacacctagaataaataagcttagaatatccaagaagtgccaggggcggtagttcacgcctgtaatcccagcactttgggaggccgaggcaggcggatcacctgaagtcaggaggagaccagcctggccaacatggagaaagcccgtctctactaaaaatacaaaaaatagactggcgtggtggcgcatgcctgtaatcccagctacccgggaggctgaggcaggagaatcgcttgacccgggaaggggaggttgcagtgagccgagatcgtgcctttgcaccccagcctgggcaataaaagtgagactgtcccaaaaacaaaacaaacaggctgggcatggtggctcacgcctgtaatcccagtagtttgggaggccgaggcaggcggattacctgaggtcaggagttcaagaccagcctggccaacatggtgaaacccgtctctactaaaaataaaaaattagccgggggtggtggcacacacctgtaatcccagctactcgggaggctgaggcgggacaactgcttgagccctggaggcggagattgcagtgagccgagatcgtgccactgcactctagcctggccgacagagcgactcaaaaaaaaaaaaaaaaaaatccaagaagtgcccaaaatagcaagcaaaggaattgtatatgtgcctatgttctttttttctgggaaggagaatctgcagctttataatttcaacatcggctaaattgtcgtgaacctaaaacaatcaaaagggccggaatctatttaaagagtttattcaagggcagtgtgaggatggaccaaccagaaaacctccaaagaatggagtcagccttcagaagtagagaagttacgatttcatttatttagggagacagaggagtttttagctggattacgttatccatacaaggttggaacataattacagaatttggttacaagaagtgttttttttggggggggggcgggggtacagctaacattgttttacgaagagtttaacacgcatgagttgctgtcatctggtgacatcgtttgagtctctctagtcattgaacagaacaagaaaaatcgaattaaatttataatctgaactgaagttatatgtgacccatcacatctctcaagttttaaaatgggtttttttgttgttgttgatggggggggagagggtccagcagcttttaaatgttttcacatcgtgtgttccaaaaataactggttagcctaagtcacttccaccctccaatgttgtgaatgcagtctctagcattcgctatttaatgtcttcttcctgcactatttgagaaatcgcgaggtcgacttaataccgcagtcgccacttcgcggaccggagggcggagtctgcttagttctgaggactgcgtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatg

SEQ ID NO: 157796 - DNA, 1059 bp, Homo sapiens
  Payload ID: 10927
  Gene Symbol: NACA
  Gene Name: nascent polypeptide-associated complex alpha subunit
  Uniprot ID: Q13765
  ENST ID: ENST00000393891
  CDS Start-End: 309-956
gcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaaggaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 157797 - DNA, 6629 bp, Homo sapiens
  Payload ID: 10927
  Gene Symbol: NACA
  Gene Name: nascent polypeptide-associated complex alpha subunit
  Uniprot ID: E9PAV3
  ENST ID: ENST00000454682
  CDS Start-End: 283-6519
ggagtctgcttagttctgaggactgcgtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagctgtgctacctatgtcttcagccttgagtgtcactgctgccttagggcagcctggacctaccctcccccctccttgctctcctgccccacaacagtgccctctctcagctgctaaccaggcttccccattcccttccccctctactattgcctcgacccctttagaagttccttttccccagtcatcctctggaacagccctacctttgggaactgcccctgaagccccaaccttcctaccaaacctaatagggcctcccatctccccagctgccttagctctagcctctcccatgatagctccaactctgaaagggaccccttcctcttcagctcccttagctctggttgccctggctccccactcagttcagaagagttctgcttttccacctaaccttcttacttcacctccttcagtggctgtagctgagtcagggtcagtgataactctgtcagctcccattgctccctcagaaccaaagactaatcttaataaagttccctctgaggtagtccctaatccaaaaggcacccccagccctccatgtatagtcagtactgttccttaccactgtgtgactcccatggcctctattcaatctggagtggcctcccttcctcagacaacacccacaactaccctagccatcgcttcccctcaagtcaaagataccaccatttcctcagttctgatttctccacaaaacccaggaagcctcagcctgaaggggcctgttagtccacctgctgccttatctctttcaactcagtctcttcctgtggtgacctcttctcaaaagactgcgggtcccaacacccccccagattttcccatttctctgggctctcatcttgcacctttacatcagagttcttttggttctgtccaacttttaggtcaaacaggtcctagtgctttgtcagaccctacagtgaagaccatttctgtagatcattcttccacaggggcctcttatccttctcagagatctgtaattcctccccttccttccagaaatgaggtagttcctgctactgtggctgcctttccagtggtggctccatctgttgacaaaggtccctctaccatctctagcataacctgcagcccttctggctccttaaatgtagctacctctttttcattatctcctacaacctctctcattctcaaaagctctcctaatgccacttatcattatcctttagtggcccaaatgcccgtttcttctgttggaaccaccccacttgtggtgactaacccctgtacaattgctgcagcacctactactacctttgaggtagctacttgtgtttctcctccaatgtcatcaggtcccataagtaacatagaaccaacttcccctgctgccttggttatggcacctgtggctcccaaagagccttctactcaagtagcaaccactctgaggataccagtctctcctcctctgccagaccctgaagacctcaaaaatctccccagttcagtattggttaaatttccaacacaaaaagacctccaaactgtacctgcctctcttgaaggagcccctttctctccagcccaagcaggactcaccaccaagaaagaccctactgtattaccgttagtccaggcagcccctaaaaattccccttctttccaaagtacatcctcttctccagagatacctctttctcctgaagccaccctagcaaagaaaagccttggggagcctctccctataggtaagccagccagcagtatgacctcccctctgggtgttaactcctcggcctctgtaatcaagacagattcttatgcaggcccagactctgctggtccgcttctcaaaagttctctcattaccccaacagtggctgcatttcctttggaaagtgctgaccctgccggggtggctcccacaactgccaaaggtacctcaacttatacaactacagccagcccttttctagaaggaactgtctctttagctcctaaaaaccacccagttaaggaaggtactcttactactttacccttggttcctacagcttcagaaaattgccctgtggctccatccccccagaatacctgtgctcctctggctaccttagtgctggcccctgaaatcccaaagtctgtgccctcaccctctcttcccccagctgggactcctccaggtacaaaaaaggttgatggtatttctcatacttcagcattggcacctgttgcttcctctcccaaagagtgcccaactgaggactctggtgcttctgctactgcatcttccaaaggaactctgacttacctagctgattccccatctcctttaggggttagtgtgtctcctcagactaaaagacctccaaccaagaagggttctgctggccctgatactcctattggaaatctctcatcccctgtttctccagttgaagcttcatttcttccagagaatagtctttctttccaaggctctaaagactcaccagccacgacgcattctcccactcctccatcccccaaaggggcccctactccctcagctgtgactcctctgtctcccaaaggagtaacactaccccccaaagagacccccactccttcagtggtgaatctgcccttccccaaagagggtccagctactccagcacccaaacaggctcctgctctatccatgacttcttcctcccccaaaaaggcccgagcaactccagcccctaaaggaatcccagcttccccatcccccaaaggggcccccacacccccagctgcaactcctccctcccctaaaggaggcccagctaccccatccccgaaatgggcccccacacccccagctgcaactcctccctccccaaaaggaggtccagctactccatcccccaaaggggcccccacacccccagctgcaactcctccctcccccaaaggaggtccagctactccatcccccaaaggggcccccacacccccagctgtgactcctccctcccccaaaggaagtccagcagctaccccattccccaaaggggcatccacacccccagctgcaactcctccctcccccaaaggaagtccagcagctaccccactccccaaaggggcccccacaaccccagctgcaactcttccctccccaaaaggaggtccagctaccccatccctcaagggggcccccactcccccagctgcgactcctccctccccaaaaggaggcccagctaccccatcccccaaaggggcccccatgcccccagctgcaactcctccctccccaaaaggaggtctagctaccccaccccacaaaggggcacccacaaccccagctgcaactcctccctccccaaaaggaggtctagctaccccacccccaaaaggggcccccacaaccccagctgcaactcctccttccccaaaaggaggtctagctaccccacccccaaaaggggcccccacaaccccagctgcaactcctccttccccaaaaggaggtctagctaccccatcccccaaaggggcccccacaaccccagctgcaactcctccctccccaaaaggaggtctagctaccccatcccccaaaggggcccccacaaccccagctgcaactcctccctccccaaaaggaggtctggctaccccatcccccaaaggggcccccacaaccccagctgcaactcctccctccccaaaaggaggcccagctaccccaccccccaaaggggcccccactcccccagctgcaactcctccctccctaaaaggaggtctagctaccccaccccacaaaggggcccccaatcccgcagttgtaactcctccctctccaaaaggaggcccagctacctcaccccccaaaggggcccccactcctccagctgcaactcctccctccccaaaaggaagcccaggtaccccaccccccaaaggggcccccactcccccagctgtaactcctccctcccctaaagggacccctactctcccagctacaactccctcctctaaaggaggcccaactactccatcctccaaagagggccccactcccccagctgcaaccccctcccacaaaggaggtcccgctatgactcctccctcccccaaaagaggaccagctatcccatctcccaaaggggaccccacttccccagcagtgattcctctctcccccaaaaaggctccagcaactccagtcaccagagaaggcgcagccaccccatccaaaggagatctcactcccccagcagtgactcctgtctccctcaaaaaggccccagcaacttcagcccccaaaggaggcccagctaccccatcctccaaaggggatcccaccctcccagcagtgactcctccttcccccaaggagcccccagcccccaaacaagttgccacttcttcctctcccaaaaaggccccagcaactccagcccccatgggggcccccactctgccagctgtgattccttcttcccccaaagaggtcccagctaccccatcctccagaagggaccccattgccccaacagcgactcttctctctaaaaagaccccagcaactctagcccccaaagaggccctcattcccccagctatgactgttccctcccctaaaaagaccccagcaattccaacccccaaagaagccccagctaccccatcctccaaagaggcctccagtcccccagcagtgactccttccacttacaaaggggccccatcccccaaagagctcctcattccaccagctgtgacttctccttcccccaaagaggcacctactcctccagctgtgactcctccatcccccgaaaagggcccagcaactccagcccccaaagggactcccacttccccacctgtgactccttcctccctcaaagactcccctacttccccagcttctgtcacatgtaaaatgggggccactgttcctcaagcatctaaagggcttccagcaaagaaaggccccacagctctgaaagaagtacttgttgccccagctccagaaagcacgccaatcatcacagctcccactcggaaaggtccacagaccaaaaagagttctgctacttcacctcctatatgcccagatccctcagctaagaatggttctaaaggacccctttccacagtggctccagcccctctactccctgttcagaaagactcttcaaagacagcaaaaggcaaagatgcttctcattccccaaagggccccttggctcctcctgagtctaaggcgtccacccctctaacagcagctgcctttgagaaggtccttcctaaacctgaatcagcatctgtctctgcagcaccctccccaccagtctctctgcctcttgctccctccccagttcccactctgcctcctaaacagcaatttctgccgtcctctcctgggctggtgttggaatcaccctctaaaccccttgcccctgctgatgaggatgagctgctgcctctgattcccccggaaccaatctctgggggagtgcctttccagtcggtcctcgtcaacatgcccacccctaaatctgctggaatccctgtcccaaccccctctgccaagcaacctgttacgaagaacaacaaggggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatgaattc

SEQ ID NO: 157798 - DNA, 543 bp, Homo sapiens
  Payload ID: 10927
  Gene Symbol: NACA
  Gene Name: nascent polypeptide-associated complex alpha subunit
  ENST ID: ENST00000547914
  CDS Start-End: 39-257
tttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaacc

SEQ ID NO: 157799 - DNA, 802 bp, Homo sapiens
  Payload ID: 10927
  Gene Symbol: NACA
  Gene Name: nascent polypeptide-associated complex alpha subunit
  Uniprot ID: Q13765
  ENST ID: ENST00000546392
  CDS Start-End: 121-768
cccctccgctccaggcttccttctgcaacaggcgtgggtcacgctctcgctcggtctttctgccgccatcttggttccgcgttccctgcacagcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaag

SEQ ID NO: 157800 - DNA, 492 bp, Homo sapiens
  Payload ID: 10927
  Gene Symbol: NACA
  Gene Name: nascent polypeptide-associated complex alpha subunit
  ENST ID: ENST00000546862
  CDS Start-End: 279-492
cttggttccgcgttccctgcacaaaatgcccggcgaagccacagaaaccgtccctgctacagagcaggagttgccgcagccccaggctgagacagttgtttctcatcttagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtct

SEQ ID NO: 157801 - DNA, 690 bp, Homo sapiens
  Payload ID: 10927
  Gene Symbol: NACA
  Gene Name: nascent polypeptide-associated complex alpha subunit
  ENST ID: ENST00000549259
  CDS Start-End: 97-690
gtgacaagcaagtgttggacttaaaacaccgtctttcccctcctggtaccccaaagtcggcaaacgtagtccaggaggccccagcccagccagtaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagcc

SEQ ID NO: 157802 - DNA, 542 bp, Homo sapiens
  Payload ID: 10927
  Gene Symbol: NACA
  Gene Name: nascent polypeptide-associated complex alpha subunit
  ENST ID: ENST00000548084
  CDS Start-End: 312-416
cctgcacagtaagtactttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaaggaaatgcccggcgaagccacagaaaccgtccctgctacagagcaggagttgccgcagccccaggctgagacagttgtttctcatcttagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggag

SEQ ID NO: 157803 - DNA, 299 bp, Homo sapiens
  Payload ID: 10927
  Gene Symbol: NACA
  Gene Name: nascent polypeptide-associated complex alpha subunit
  ENST ID: ENST00000546917
  CDS Start-End: 283-299
gtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacagcctcctttttattcccttccttcagaaatgcccggcgaagccac

SEQ ID NO: 157804 - DNA, 827 bp, Homo sapiens
  Payload ID: 10927
  Gene Symbol: NACA
  Gene Name: nascent polypeptide-associated complex alpha subunit
  ENST ID: ENST00000548563
  CDS Start-End: 319-729
ctttctgccgccatcttggttccgcgttccctgcacagcctcctttttattcccttccttcagaaatgcccggcgaagccacagaaaccgtccctgctacagagcaggagttgccgcagccccaggctgagacagttgtttctcatcttagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttg

SEQ ID NO: 157805 - DNA, 711 bp, Homo sapiens
  Payload ID: 10927
  Gene Symbol: NACA
  Gene Name: nascent polypeptide-associated complex alpha subunit
  ENST ID: ENST00000549855
  CDS Start-End: 333-711
aactatatatgtgtcttaaacctcaaagtaaattttccttgagaaataatttatgttgaaaagatttcctggccaagtgcagtggctcacacccgtaatcccagcactttgggaggccgaggcaggcggatcacctgagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgccatcttggttccgcgttccctgcacaaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagcca

SEQ ID NO: 157806 - DNA, 1074 bp, Homo sapiens
  Payload ID: 10927
  Gene Symbol: NACA
  Gene Name: nascent polypeptide-associated complex alpha subunit
  Uniprot ID: Q13765
  ENST ID: ENST00000552540
  CDS Start-End: 324-971
actttctgtgccgctactgtctatccgcagccatccgcctttctttcgggctaagccgccccggggactgagagttaaggagagttggaggctttactgggccacagggttcctactcgcccctgggcctccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaagggcctcctttttattcccttccttcagaaatgcccggcgaagccacagaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttgga

SEQ ID NO: 157807 - DNA, 2922 bp, Homo sapiens
  Payload ID: 10927
  Gene Symbol: NACA
  Gene Name: nascent polypeptide-associated complex alpha subunit
  Uniprot ID: E9PAV3
  ENST ID: ENST00000550952
  CDS Start-End: 40-2817
ctttctgccgccatcttggttccgcgttccctgcacaaaatgcccggcgaagccacagaaaccgtccctgctacagagcaggagttgccgcagccccaggctgagacagctgtgctacctatgtcttcagccttgagtgtcactgctgccttagggcagcctggacctaccctcccccctccttgctctcctgccccacaacagtgccctctctcagctgctaaccaggcttccccattcccttccccctctactattgcctcgacccctttagaagttccttttccccagtcatcctctggaacagccctacctttgggaactgcccctgaagccccaaccttcctaccaaacctaatagggcctcccatctccccagctgccttagctctagcctctcccatgatagctccaactctgaaagggaccccttcctcttcagctcccttagctctggttgccctggctccccactcagttcagaagagttctgcttttccacctaaccttcttacttcacctccttcagtggctgtagctgagtcagggtcagtgataactctgtcagctcccattgctccctcagaaccaaagactaatcttaataaagttccctctgaggtagtccctaatccaaaaggcacccccagccctccatgtatagtcagtactgttccttaccactgtgtgactcccatggcctctattcaatctggagtggcctcccttcctcagacaacacccacaactaccctagccatcgcttcccctcaagtcaaagataccaccatttcctcagttctgatttctccacaaaacccaggaagcctcagcctgaaggggcctgttagtccacctgctgccttatctctttcaactcagtctcttcctgtggtgacctcttctcaaaagactgcgggtcccaacacccccccagattttcccatttctctgggctctcatcttgcacctttacatcagagttcttttggttctgtccaacttttaggtcaaacaggtcctagtgctttgtcagaccctacagtgaagaccatttctgtagatcattcttccacaggggcctcttatccttctcagagatctgtaattcctccccttccttccagaaatgaggtagttcctgctactgtggctgcctttccagtggtggctccatctgttgacaaaggtccctctaccatctctagcataacctgcagcccttctggctccttaaatgtagctacctctttttcattatctcctacaacctctctcattctcaaaagctctcctaatgccacttatcattatcctttagtggcccaaatgcccgtttcttctgttggaaccaccccacttgtggtgactaacccctgtacaattgctgcagcacctactactacctttgaggtagctacttgtgtttctcctccaatgtcatcaggtcccataagtaacatagaaccaacttcccctgctgccttggttatggcacctgtggctcccaaagagccttctactcaagtagcaaccactctgaggataccagtctctcctcctctgccagaccctgaagacctcaaaaatctccccagttcagtattggttaaatttccaacacaaaaagacctccaaactgtacctgcctctcttgaaggagcccctttctctccagcccaagcaggactcaccaccaagaaagaccctactgtattaccgttagtccaggcagcccctaaaaattccccttctttccaaagtacatcctcttctccagagatacctctttctcctgaagccaccctagcaaagaaaagccttggggagcctctccctatagtggctgcatttcctttggaaagtgctgaccctgccggggtggctcccacaactgccaaagcagctgcctttgagaaggtccttcctaaacctgaatcagcatctgtctctgcagcaccctccccaccagtctctctgcctcttgctccctccccagttcccactctgcctcctaaacagcaatttctgccgtcctctcctgggctggtgttggaatcaccctctaaaccccttgcccctgctgatgaggatgagctgctgcctctgattcccccggaaccaatctctgggggagtgcctttccagtcggtcctcgtcaacatgcccacccctaaatctgctggaatccctgtcccaaccccctctgccaagcaacctgttacgaagaacaacaaggggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatg

SEQ ID NO: 157808 - DNA, 752 bp, Homo sapiens
  Payload ID: 10927
  Gene Symbol: NACA
  Gene Name: nascent polypeptide-associated complex alpha subunit
  ENST ID: ENST00000550920
  CDS Start-End: 1-642
acagtggctgcatttcctttggaaagtgctgaccctgccggggtggctcccacaactgccaaagggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatgaattc

SEQ ID NO: 157809 - DNA, 521 bp, Homo sapiens
  Payload ID: 10927
  Gene Symbol: NACA
  Gene Name: nascent polypeptide-associated complex alpha subunit
  ENST ID: ENST00000552055
  CDS Start-End: 78-521
ggagcagttgcagtgttgagggcggaagaggagtgcgtcttgttttgggaactgcttcacaggatccagaaaaggaaatgcccggcgaagccacagaaaccgtccctgctacagagcaggagttgccgcagccccaggctgagacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaac

SEQ ID NO: 157810 - DNA, 777 bp, Homo sapiens
  Payload ID: 10928
  Gene Symbol: NACA2
  Gene Name: nascent polypeptide-associated complex alpha subunit 2
  Uniprot ID: Q9H009
  ENST ID: ENST00000521764
  CDS Start-End: 23-670
gcttccgcgttccctgcacaaaatgccgggcgaagccacagaaaccgtccctgctacagagcaggagttgccgcagtcccaggctgagacagggtctggaacagcatctgatagtggtgaatcagtaccagggattgaagaacaggattccacccagaccaccacacaaaaagcctggctggtggcagcagctgaaattgatgaagaaccagtcggtaaagcaaaacagagtcggagtgaaaagagggcacggaaggctatgtccaaactgggtcttctacaggttacaggagttactagagtcactatctggaaatctaagaatatcctctttgtcatcacaaaactggacgtctacaagagccctgcttcggatgcctacatagtttttggggaagccaagatccaagatttatctcagcaagcacaactagcagctgcggagaaattcagagttcaaggtgaagctgtcggaaacattcaagaaaacacacagactccaactgtacaagaggagagtgaagaggaagaggtcgatgaaacaggtgtagaagttaaagacgtgaaattggtcatgtcacaagcaaatgtgtcgagagcaaaggcagtccgagctctgaagaacaacagtaatgatattgtaaatgcgattatggaattaacagtgtaaccatctgaaagcaactttttttggtgtctcaaaggagtaactgcagcttggtttgaaatttgtactgtttctatcataaataaagttatgacttcttgctggaaaaa

SEQ ID NO: 157811 - DNA, 728 bp, Homo sapiens
  Payload ID: 10929
  Gene Symbol: NPPA
  Gene Name: natriuretic peptide A
  ENST ID: ENST00000376476
  CDS Start-End: 293-598
ggactgccaggggtgaaggcagccctgtctgaggccagaggtctgcccacgtggcggatgaggcaggtgtgaggccagcttgagcatctggatccatttgtctcgggctgctggctgcctgccatttcctcctctccacccttatttggaggccctgacagctgagccacaaacaaaccaggggagctgggcaccagccaagcgtcaccctctgtttccccgcacgggtaccagcgtcgaggagaaagaatcctgaggcacggcgaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctg

SEQ ID NO: 157812 - DNA, 855 bp, Homo sapiens
  Payload ID: 10929
  Gene Symbol: NPPA
  Gene Name: natriuretic peptide A
  Uniprot ID: P01160
  ENST ID: ENST00000376480
  CDS Start-End: 100-555
gagacagggacagacgtaggccaagagaggggaaccagagaggaaccagaggggagagacagagcagcaagcagtggattgctccttgacgacgccagcatgagctccttctccaccaccaccgtgagcttcctccttttactggcattccagctcctaggtcagaccagagctaatcccatgtacaatgccgtgtccaacgcagacctgatggatttcaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtactgaagataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaattttaaggtagaacctcacctgttactgaaagtggtttgaaagtgaataaacttcagcaccatggacagaagacaaa

SEQ ID NO: 157813 - DNA, 849 bp, Homo sapiens
  Payload ID: 10929
  Gene Symbol: NPPA
  Gene Name: natriuretic peptide A
  ENST ID: ENST00000610706
  CDS Start-End: 100-558
gagacagggacagacgtaggccaagagaggggaaccagagaggaaccagaggggagagacagagcagcaagcagtggattgctccttgacgacgccagcatgagctccttctccaccaccaccgtgagcttcctccttttactggcattccagctcctaggtcagaccagagctaatcccatgtacaatgccgtgtccaacgcagacctgatggatttcaagaatttgctggaccatttggaagaaaagatgcctttagaagatgaggtcgtgcccccacaagtgctcagtgagccgaatgaagaagcgggggctgctctcagccccctccctgaggtgcctccctggaccggggaagtcagcccagcccagagagatggaggtgccctcgggcggggcccctgggactcctctgatcgatctgccctcctaaaaagcaagctgagggcgctgctcactgcccctcggagcctgcggagatccagctgcttcgggggcaggatggacaggattggagcccagagcggactgggctgtaacagcttccggtacagataacagccagggaggacaagcagggctgggcctagggacagactgcaagaggctcctgtcccctggggtctctgctgcatttgtgtcatcttgttgccatggagttgtgatcatcccatctaagctgcagcttcctgtcaacacttctcacatcttatgctaactgtagataaagtggtttgatggtgacttcctcgcctctcccaccccatgcattaaattttaaggtagaacctcacctgttactgaaagtggtttgaaagtgaataaacttcagcaccatggacagaagac

SEQ ID NO: 157814 - DNA, 694 bp, Homo sapiens
  Payload ID: 10930
  Gene Symbol: NPPB
  Gene Name: natriuretic peptide B
  Uniprot ID: P16860
  ENST ID: ENST00000376468
  CDS Start-End: 99-503
gcaggctgagggcaggtgggaagcaaacccggacgcatcgcagcagcagcagcagcagcagaagcagcagcagcagcctccgcagtccctccagagacatggatccccagacagcaccttcccgggcgctcctgctcctgctcttcttgcatctggctttcctgggaggtcgttcccacccgctgggcagccccggttcagcctcggacttggaaacgtccgggttacaggagcagcgcaaccatttgcagggcaaactgtcggagctgcaggtggagcagacatccctggagcccctccaggagagcccccgtcccacaggtgtctggaagtcccgggaggtagccaccgagggcatccgtgggcaccgcaaaatggtcctctacaccctgcgggcaccacgaagccccaagatggtgcaagggtctggctgctttgggaggaagatggaccggatcagctcctccagtggcctgggctgcaaagtgctgaggcggcattaagaggaagtcctggctgcagacacctgcttctgattccacaaggggctttttcctcaaccctgtggccgcctttgaagtgactcatttttttaatgtatttatgtatttatttgattgttttatataagatggtttcttacctttgagcacaaaatttccacggtgaaataaagtcaacattataagcttta

SEQ ID NO: 157815 - DNA, 500 bp, Homo sapiens
  Payload ID: 10931
  Gene Symbol: NPPC
  Gene Name: natriuretic peptide C
  Uniprot ID: P23582
  ENST ID: ENST00000295440
  CDS Start-End: 80-460
cgcatccccctgctggtctgcccgccgacctgcgcgccctcgctgccgcccgtgtgcgcccctcgaccccagcggcaccatgcatctctcccagctgctggcctgcgccctgctgctcacgctgctctccctccggccctccgaagccaagcccggggcgccgccgaaggtcccgcgaaccccgccggcagaggagctggccgagccgcaggctgcgggcggcggtcagaagaagggcgacaaggctcccgggggcgggggcgccaatctcaagggcgaccggtcgcgactgctccgggacctgcgcgtggacaccaagtcgcgggcagcgtgggctcgccttctgcaagagcaccccaacgcgcgcaaatacaaaggagccaacaagaagggcttgtccaagggctgcttcggcctcaagctggaccgaatcggctccatgagcggcctgggatgttagtgcggcgccccctggcggcggtgagtacggcccacccgac

SEQ ID NO: 157816 - DNA, 1051 bp, Homo sapiens
  Payload ID: 10931
  Gene Symbol: NPPC
  Gene Name: natriuretic peptide C
  Uniprot ID: P23582
  ENST ID: ENST00000409852
  CDS Start-End: 155-535
cgggctcagagcgcacccagccggcgccgcgcagcactgggaccctgctcgccctgcagcccagccagcctgctccgcatccccctgctggtctgcccgccgacctgcgcgccctcgctgccgcccgtgtgcgcccctcgaccccagcggcaccatgcatctctcccagctgctggcctgcgccctgctgctcacgctgctctccctccggccctccgaagccaagcccggggcgccgccgaaggtcccgcgaaccccgccggcagaggagctggccgagccgcaggctgcgggcggcggtcagaagaagggcgacaaggctcccgggggcgggggcgccaatctcaagggcgaccggtcgcgactgctccgggacctgcgcgtggacaccaagtcgcgggcagcgtgggctcgccttctgcaagagcaccccaacgcgcgcaaatacaaaggagccaacaagaagggcttgtccaagggctgcttcggcctcaagctggaccgaatcggctccatgagcggcctgggatgttagtgcggcgccccctggcggcggatcgggaactggctccgttgtgctgaggtcatctttggtcatcagcctccagcatctggaaacacctccaacgcaatgtggcttttacatttctttctttctttctttttttttcctggtactgggaatacacaacaccagctgttttattattatttggggagggggttgtgattttattatttgtttttttaaaatgaaaaataaaaagttatatattatatatatattatatacatgaaacacacacacctacaccgacttgatgacaagggacagtttttaagagactgacagaaccagctgtaaaacattgctgtttgtaaattcatgtcatgcataaatgtatttatgttgtaaagctatttatattgtttataaagagatatttataaaaattttatttatgtaactaaatgaaagaagtcaatcattgtaatgtttttgtcctaactagttaaaaaaaatgtaaaaaaaaaaaagtcattccatgaa

SEQ ID NO: 157817 - DNA, 4236 bp, Homo sapiens
  Payload ID: 10932
  Gene Symbol: NPR1
  Gene Name: natriuretic peptide receptor 1
  Uniprot ID: P16066
  ENST ID: ENST00000368680
  CDS Start-End: 473-3658
ggttccctccggatagccggagacttgggccggccggacgccccttctggcacactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgagttatctacatctgcagctcccctgatgccttcagaaccctcatgctcctggccctggaagctggcttgtgtggggaggactacgttttcttccacctggatatctttgggcaaagcctgcaaggtggacagggccctgctccccgcaggccctgggagagaggggatgggcaggatgtcagtgcccgccaggcctttcaggctgccaaaatcattacatataaagacccagataatcccgagtacttggaattcctgaagcagttaaaacacctggcctatgagcagttcaacttcaccatggaggatggcctggtgaacaccatcccagcatccttccacgacgggctcctgctctatatccaggcagtgacggagactctggcacatgggggaactgttactgatggggagaacatcactcagcggatgtggaaccgaagctttcaaggtgtgacaggatacctgaaaattgatagcagtggcgatcgggaaacagacttctccctctgggatatggatcccgagaatggtgccttcagggttgtactgaactacaatgggacttcccaagagctggtggctgtgtcggggcgcaaactgaactggcccctggggtaccctcctcctgacatccccaaatgtggctttgacaacgaagacccagcatgcaaccaagatcacctttccaccctggaggtgctggctttggtgggcagcctctccttgctcggcattctgattgtctccttcttcatatacaggaagatgcagctggagaaggaactggcctcggagctgtggcgggtgcgctgggaggacgttgagcccagtagccttgagaggcacctgcggagtgcaggcagccggctgaccctgagcgggagaggctccaattacggctccctgctaaccacagagggccagttccaagtctttgccaagacagcatattataagggcaacctcgtggctgtgaaacgtgtgaaccgtaaacgcattgagctgacacgaaaagtcctgtttgaactgaagcatatgcgggatgtgcagaatgaacacctgaccaggtttgtgggagcctgcaccgacccccccaatatctgcatcctcacagagtactgtccccgtgggagcctgcaggacattctggagaatgagagcatcaccctggactggatgttccggtactcactcaccaatgacatcgtcaagggcatgctgtttctacacaatggggctatctgttcccatgggaacctcaagtcatccaactgcgtggtagatgggcgctttgtgctcaagatcaccgactatgggctggagagcttcagggacctggacccagagcaaggacacaccgtttatgccaaaaagctgtggacggcccctgagctcctgcgaatggcttcaccccctgtgcggggctcccaggctggtgacgtatacagctttgggatcatccttcaggagattgccctgaggagtggggtcttccacgtggaaggtttggacctgagccccaaagagatcatcgagcgggtgactcggggtgagcagccccccttccggccctccctggccctgcagagtcacctggaggagttggggctgctcatgcagcggtgctgggctgaggacccacaggagaggccaccattccagcagatccgcctgacgttgcgcaaatttaacagggagaacagcagcaacatcctggacaacctgctgtcccgcatggagcagtacgcgaacaatctggaggaactggtggaggagcggacccaggcatacctggaggagaagcgcaaggctgaggccctgctctaccagatcctgcctcactcagtggctgagcagctgaagcgtggggagacggtgcaggccgaagcctttgacagtgttaccatctacttcagtgacattgtgggtttcacagcgctgtcggcggagagcacacccatgcaggtggtgaccctgctcaatgacctgtacacttgctttgatgctgtcatagacaactttgatgtgtacaaggtggagacaattggcgatgcctacatggtggtgtcagggctccctgtgcggaacgggcggctacacgcctgcgaggtagcccgcatggccctggcactgctggatgctgtgcgctccttccgaatccgccaccggccccaggagcagctgcgcttgcgcattggcatccacacaggacctgtgtgtgctggagtggtgggactgaagatgccccgttactgtctctttggggatacagtcaacacagcctcaagaatggagtctaatggggaagccctgaagatccacttgtcttctgagaccaaggctgtcctggaggagtttggtggtttcgagctggagcttcgaggggatgtagaaatgaagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgggctgtggattcctgatcccctcccctccccatgctctcctccctcagccttgctaccctgtgacttactgggaggagaaagagtcacctgaaggggaacatgaaaagagactaggtgaagagagggcaggggagcccacatctggggctggcccacaatacctgctcccccgaccccctccacccagcagtagacacagtgcacaggggagaagaggggtggcgcagaagggttgggggcctgtatgccttgcttctaccatgagcagagacaattaaaatctttattccagtga

SEQ ID NO: 157818 - DNA, 3686 bp, Homo sapiens
  Payload ID: 10933
  Gene Symbol: NPR2
  Gene Name: natriuretic peptide receptor 2
  Uniprot ID: P20594
  ENST ID: ENST00000342694
  CDS Start-End: 256-3399
tccccctgccaccccgttctcagtcctcagtccttgccctaggctggtagcccactccttgcccgccccccgccttcctcccatctccccctcctctccccggcccccagcaccttctgcatcccagcctacctagcctactcctcctcttcctggccctcttccccaggctccaggctggggggtgctcgcgtctcccctgtaggccagagcagccccaagttctgggggcggtggggctgctgctttatccccatggcgctgccatcacttctgctgttggtggcagccctggcaggtggggtgcgtcctcccggggcgcggaacctgacgctggcggtggtgctgccagaacacaacctgagctatgcctgggcctggccacgggtgggacccgctgtggcactagctgtggaggctctgggccgggcactgcccgtggacctgcggtttgtcagctccgaactggaaggcgcctgctctgagtacctggcaccgctgagcgctgtggacctcaagctgtaccatgaccccgacctgctgttaggtcccggttgcgtgtaccctgctgcctctgtggcccgctttgcctcccactggcgccttcccctgctgactgcgggtgctgtggcctctggtttttcggctaagaatgaccattatcgtaccctggttcgcactggcccctctgctcccaagctgggtgagtttgtggtgacactacacgggcacttcaattggactgcccgtgctgccttgctgtacctggatgctcgcacagatgaccggcctcactacttcaccatcgagggcgtctttgaggccctgcagggcagcaacctcagtgtgcagcaccaggtgtatgcccgagagccagggggccccgagcaggccacccacttcatccgggccaacgggcgcattgtgtatatctgcggccctctggagatgctgcatgagatcctgcttcaggcccagagggagaatctgaccaatggggattatgtcttcttttacctggatgtctttggggagagtctccgtgcaggccccacacgtgctacaggccggccctggcaggacaatcgcacccgggaacaggcccaggccctcagagaggcctttcagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactgggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaagttctgatgtcat

SEQ ID NO: 157819 - DNA, 543 bp, Homo sapiens
  Payload ID: 10933
  Gene Symbol: NPR2
  Gene Name: natriuretic peptide receptor 2
  ENST ID: ENST00000447210
  CDS Start-End: 1-495
aatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctactttctgtaaatatctgtatctaaaccagaatattttggtcaaatataaaacaataat

SEQ ID NO: 157820 - DNA, 824 bp, Homo sapiens
  Payload ID: 10933
  Gene Symbol: NPR2
  Gene Name: natriuretic peptide receptor 2
  ENST ID: ENST00000421267
  CDS Start-End: 1-824
acagcattatttcatcgcatgggagtctcaagtcctccaactgtgtggtggatagtcgttttgtgctcaaaatcacagactatggcctggccagcttccgatcaactgctgaacctgatgacagccatgccctctatgccagcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcacca

SEQ ID NO: 157821 - DNA, 730 bp, Homo sapiens
  Payload ID: 10933
  Gene Symbol: NPR2
  Gene Name: natriuretic peptide receptor 2
  ENST ID: ENST00000448821
  CDS Start-End: 1-229
accccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaagggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaaacccccattctttccaagtcagatagtcttctgctgctggtacctgggtgggcaatggccaccatgtctgcacacaccagaaatggacattttcatatgcaatggaaaacagccacaaaaaaacctaccttatatggaagttgtagccctctgcagctcagccctgtacatatacctgtccctctctggcttggtccccttcctccctactttctgtaaatatctgtatctaaaccagaatattttggtcaaatataaaacaataataaaaaaa

SEQ ID NO: 157822 - DNA, 7344 bp, Homo sapiens
  Payload ID: 10934
  Gene Symbol: NPR3
  Gene Name: natriuretic peptide receptor 3
  Uniprot ID: P17342
  ENST ID: ENST00000265074
  CDS Start-End: 344-1969
acgcccaaataagaagccacctctaagcaaaatagtatatgtataaacggagggcgaatatatacaagtatatatatatgtatattacagacgcacaggtttacacccggtgaactttttctttttctttttcttttttttttaagaaaaactagtgacattgcagagaaggacgcttcctctctatcttttggcgcattagtgaagggggtattctattttgttaaagcgcccaagggggcgcagggaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctctagagctggaggacaggtttgtggttgaggacttctctgtccgatgtctacattcaggttctgacttcatatcttgaaaaaggatttcctccctgtctttttcagtgtctcataaacgctactctggattgttgtaaatattagtgagatgggaggatttacagaagaaaagcaagtcaaaaatatttcctttttgatgtaaaaaaaaaaagccctatttcgcactaacattttattttacaagtattttaatcttatattttggtattagaaaaatttgtctattttttcattttgaagattaaatgttgcttacattttaaaagcatgggtgaagtgtacaacaaaccaataatgataaaaaatacttctctttttctccctgtttccctttttcccttggccacagccaaatgctaattgctgctttaattacagagatgtgtaaatgtattcagattacaaactctacaggaatacatcaacattttaactcttttgcgtttttactgtttaactgttttaaatgcaagttattttagggtgacactccttccagttctggccagatcatgagtttcaagatcaagagtaaaaagttattagaattaaacagttttataaagggaggcagcccttttccctcaagaacaactttgttgagagttactacttgacagcaagcacagaaatgacaaatttaaaacttttacacatggcatttaccaaaattcccagtgattattttgtttaaaagagggaacctaaatatctactctattccctttcagttaactccacagaactttgtaggcatccatgaatacctgtaatagtgggttaggtgtggagataaggaatttggacaaagttgagtaagtttttactgggtatctgctttgcacccagtagtctgcaacatgagtttaaactcaggttactactttcacttatactttatggagaagatagacagtgagggaggaatgggaagctgtcatgagagtgcaccgtcttggaattacataactggggtctttcctcaataacattttgagcatctgaaaaatagtttaaaaaattgtcttaatatctattaaaaggcatgtctagtgaggaaacaggagagtctgagcaatcccttggtggcgatgaaggtggtagttcacacaagtaacagtggaggcaaaggtaagcgcaagctgcctgtcccagatgctggcccatgtgtgagtgcttccctggagaagtccgcttctgttgctcccacctgagtcacagttaacagattatttctgtgtgaggcacatttcccttctgttgtttaagaaatgggagctgggaggcagctgagagggcgtgataaaagaattaagtgtgatcaactgaaacaactatgttgtagttctccatgctggatgcaaaggaaaaagtgtcgaattccaaaaaggatggaagaagaaggcaagaagggcaaactccagaagttctagtgcaggaagagagtttgagaagtaaaatccaggcaagcaaagcgttgtaccacttgggactccccaaagtgaaacagcaaggaaggattgtgtccatcttacttacttgaattggagagcttgtttctctctcatttttatttttcaatgatgttttctttatattttagagatattcattttctcttatcttgtgcttgtaaaaagcatttacatttcaagtctatgtgcttattacaggggaaaaataatctacctggttgcagtctttgagtataaacatttctaacctttttaaaacttctatagcagcccattaacactaacatttttagagcaaatatattctattttaacttcaggtagaggaatagtcctaaacttaatatgatagctctagataagatcttagagataagtgagcatttagtattctaaaagtggcagaacaaatcatgaggtttctggatgctataccaatttaaaatcaattcttatgttaatattgattgcttatttacatgtcagtcatctactttttttctttgaaatctgcatatgggttacaaaaactctgttaggttttgaaaattccattaagttggaaaccttggttaaaaatgtaggtgcctggcccatggttaccctggattcaggtctctcatgattatatttggggatttacgttcctaactgctaagcaacatctttgacaactagtaattcatactctactagtagtcacatgtcatatagtaaaataaatagggctttagttcttaagtaattctataggattttaccctgaaatccagggtgttcagatttcaaaaaggataatttatcagtattttctcatccagtcaaacttcagctgacattgatacaggtcaaaatgcgtagatgctttttggtgttggaaataagtgtctgtcttatggtcatcattgtcttcttagatttttgggtaggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatgggaaaagaacacctccttttctcctttctcttaaattcaaagacgtttgctttggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaatgagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttatgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatcccacggaaa

SEQ ID NO: 157823 - DNA, 6380 bp, Homo sapiens
  Payload ID: 10934
  Gene Symbol: NPR3
  Gene Name: natriuretic peptide receptor 3
  Uniprot ID: P17342
  ENST ID: ENST00000326958
  CDS Start-End: 27-1001
ggccagccgggcacaccaggtccgcgatggagccatctgcactgggaccttggtccttgttccctgaccttgcgccgagggaccaggaaggtcaggtgctcgccccgcgtcggtgcttcaggagggaatgtggccagaacgagaaagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctctagagctggaggacaggtttgtggttgaggacttctctgtccgatgtctacattcaggttctgacttcatatcttgaaaaaggatttcctccctgtctttttcagtgtctcataaacgctactctggattgttgtaaatattagtgagatgggaggatttacagaagaaaagcaagtcaaaaatatttcctttttgatgtaaaaaaaaaaagccctatttcgcactaacattttattttacaagtattttaatcttatattttggtattagaaaaatttgtctattttttcattttgaagattaaatgttgcttacattttaaaagcatgggtgaagtgtacaacaaaccaataatgataaaaaatacttctctttttctccctgtttccctttttcccttggccacagccaaatgctaattgctgctttaattacagagatgtgtaaatgtattcagattacaaactctacaggaatacatcaacattttaactcttttgcgtttttactgtttaactgttttaaatgcaagttattttagggtgacactccttccagttctggccagatcatgagtttcaagatcaagagtaaaaagttattagaattaaacagttttataaagggaggcagcccttttccctcaagaacaactttgttgagagttactacttgacagcaagcacagaaatgacaaatttaaaacttttacacatggcatttaccaaaattcccagtgattattttgtttaaaagagggaacctaaatatctactctattccctttcagttaactccacagaactttgtaggcatccatgaatacctgtaatagtgggttaggtgtggagataaggaatttggacaaagttgagtaagtttttactgggtatctgctttgcacccagtagtctgcaacatgagtttaaactcaggttactactttcacttatactttatggagaagatagacagtgagggaggaatgggaagctgtcatgagagtgcaccgtcttggaattacataactggggtctttcctcaataacattttgagcatctgaaaaatagtttaaaaaattgtcttaatatctattaaaaggcatgtctagtgaggaaacaggagagtctgagcaatcccttggtggcgatgaaggtggtagttcacacaagtaacagtggaggcaaaggtaagcgcaagctgcctgtcccagatgctggcccatgtgtgagtgcttccctggagaagtccgcttctgttgctcccacctgagtcacagttaacagattatttctgtgtgaggcacatttcccttctgttgtttaagaaatgggagctgggaggcagctgagagggcgtgataaaagaattaagtgtgatcaactgaaacaactatgttgtagttctccatgctggatgcaaaggaaaaagtgtcgaattccaaaaaggatggaagaagaaggcaagaagggcaaactccagaagttctagtgcaggaagagagtttgagaagtaaaatccaggcaagcaaagcgttgtaccacttgggactccccaaagtgaaacagcaaggaaggattgtgtccatcttacttacttgaattggagagcttgtttctctctcatttttatttttcaatgatgttttctttatattttagagatattcattttctcttatcttgtgcttgtaaaaagcatttacatttcaagtctatgtgcttattacaggggaaaaataatctacctggttgcagtctttgagtataaacatttctaacctttttaaaacttctatagcagcccattaacactaacatttttagagcaaatatattctattttaacttcaggtagaggaatagtcctaaacttaatatgatagctctagataagatcttagagataagtgagcatttagtattctaaaagtggcagaacaaatcatgaggtttctggatgctataccaatttaaaatcaattcttatgttaatattgattgcttatttacatgtcagtcatctactttttttctttgaaatctgcatatgggttacaaaaactctgttaggttttgaaaattccattaagttggaaaccttggttaaaaatgtaggtgcctggcccatggttaccctggattcaggtctctcatgattatatttggggatttacgttcctaactgctaagcaacatctttgacaactagtaattcatactctactagtagtcacatgtcatatagtaaaataaatagggctttagttcttaagtaattctataggattttaccctgaaatccagggtgttcagatttcaaaaaggataatttatcagtattttctcatccagtcaaacttcagctgacattgatacaggtcaaaatgcgtagatgctttttggtgttggaaataagtgtctgtcttatggtcatcattgtcttcttagatttttgggtaggggggccaggtagggggagactcagaaataaaagcgttccccagataacttcaatctggaaagaattttttgtatagagtccatctctccctcaagactgaccacaggtttcatgagaaggtccctgaaaacatcacatttctctgaagaaccatcaacttgtcttttcttgaaccacaggaatggttctacagaccctactataattcttcacatttcagaacccatgtttaatggagggaagagagaaatgcatgggaaaagaacacctccttttctcctttctcttaaattcaaagacgtttgctttggaatgccctcacttctccctattcacaggcttctaaaatcattaatttactcaaggcacatgtgccttctttgccccaaatgcatcactttccttttagttatggctgattttgggtgtgtgtgtgtaagacatgcagtcaacaatgagatgaaggccattgcatagatctcatgcagatagtgatggattcagaaagtaggttccagtggcgtcactaccttcttgtaagccagtatacactggctatttgtggaaatctctttgggagatcaaatagagtattatgccactgtgagtgtttataaactggaaggaacaagtacctgtgtttcttgggacacaaagcactcagatcctgagtggatgcagacatgagagtaaatgtcagcccaaattaggcccctcgacctacagacatttcatgggttttatttaatcacaccccatggtttggggctacatgaggaagttggtaatgagctgaatttcttattcagtggaaaaaactgaaactgtctaaaaacacgggatatattttagaggcaattgtggaagcggagagaatgagatgatggtgttcagagggaccagcttctttttcagttgtctttagaactcaagaataatcaataatttagtgccccttcaacagccatactcagcaagaagaatcagaagcttgatcctctaacagaaatagaagagggtagctttgcccattgccactgtctttactgccccttctgcccctccacccacatccacattcagcatcactccaaggatgtgtcagcatcttgcccatgcaggtagaaatttgtgagtaggcctccatacttcctcgggggaagaaagagaaactagtgctggttttaagaatgtagctggcttttcatcagaacccttatgctaacctgaccacacttgctctcggggaagttcaagcctgtgatgtgcataaactccaacaagcctggctttggtgttcagcatgcacattccataaatatctcttgcaggcataccccacagctagactgcaggattaaaataacttccaaaaggtgctggattggagtttgttcaaatttctcattaaccactaatgttaattcataccaaatgcaaagtattctaaaccagctgatgctgtcagtgttcaagttttaagtgacttcaaacacaatggaagtgtttcaatgggagccagatctcatgagtaaaaatccattttataatagctctgtgatatatcagtgggagatgattcataggggagagatttgaacaagcagaattaagtgttagcaaaaatgctgcattgctttgattcatgtttaaagacctaaatttctatgcacaaggaataaagggcctacttaccaagtgtaaatcacaacataggctaccaaaatatttcttatttgctaggagaacaaagctgtcacggtgcatgatagttggacagagatggctaaaaaagaggcaaattcagatttggaaacagggtggcctcttcattatttattgccaagatctgaaaatcttcaacatcttataagacaacaatgaagtagcccctgaacagcatggagttgctgtgagtttgttcgttgcagacctttgtgttgggtcctgggaatctgagctttgttccctgtgcatggtggataattgaaaccaagaggacatgggatagaccttgtgacagaccaattctgtgacccctgtcttctgggtcacattattcattgttgatttaaatacaggactaccaaacagtacaaatctatcatgagtctggtagaaaagtaaaagtaaaagctgcacacgttacatactgtttattgttctaatgtacaactaactatttgcatataatgtgatttaatttattgctgttttgtgtagaaaaggagaactaatgactgtggatataacccatgttttgtataatatattttatttcttgtgcgaactggtcatttaaaatatctacttcatttgatgtttggatataaatgtgtatgtgtccttgtaaatgtttctatcaagcaagaatgccacgtactcagagtataacaatgtgttctcattaaaaaatacatcccacggaaacctc

SEQ ID NO: 157824 - DNA, 2715 bp, Homo sapiens
  Payload ID: 10934
  Gene Symbol: NPR3
  Gene Name: natriuretic peptide receptor 3
  ENST ID: ENST00000434067
  CDS Start-End: 1257-2234
ttctttttttttttttttaatctgtgctgccataaacgcctgcccttctgcaaattcaggaaagatttaattgctgtggagcactaaatctcaatttccagtgtgtgtggattaccctgtttgtggaattaaattttatacagatgtctcttttgctcctggttagtggctctaattaaataaatggaaattctcgcaggaattagaagctcctacttaacagtgaagatttcgggatcacagtgcataatctgaatataaatgacccagaagctgaaacattacccataatcacattgacggttccagaaagagcgataaggagagtgctgttaagggaggcgagcgctgacgccagaagttgccatatccccagaaaccccagtttgccttttcaccgtcgcaagtgagaaccagagcgcgttaaaggcctcggagtaaaaaacgcagcgtctgggactgcggcacccgggttgagtcgggtgcaagtttctgccgaaagagggcgtcggtctgagactaaaagaaatttgtggacacggacgcctagtcaaatgaaagaccattttaacacattttcaatgtatttaaatgtgcgggacttaattgtcagaattctcccgcccagtgtagcccgttcacattgcaaatgacttggctgcagtaggcacagaaggtccagttccattttgacccgccccgccgcgcggcggactcccgcgatgctcctctggtcacggacttctccagagccgcttccctccggtctccaccgctgctgtggctatggccagtgggaggactgggtctccgaggcaggacctttcttggagtcgcggaaccccagcacagtgcctcgagcgctccagagaaggagcggttggatctttgagcactcaggttggaggggagcgtgtgtcgtacccgggggacctaccgggaacgttttgggaaagacagtccctttatttaggtacctggtttagcaaacaaagccccgaggacgctttggggatgctttccaagctttgtgacacctccagaagttgaaccattccctcgcctttgggagcaacaagtttcactttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctgcactgggaccttggtccttgttccctgaccttgcgccgagggaccaggaaggtcaggtgctcgccccgcgtcggtgcttcaggagggaatgtggccagaacgagaaagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatcaggtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaacagaaggggcgttcttgaagaattcataattttaagcagttagtaatttcattttaaaatttctgtagaagctcaggaattatgattaatcaccatctgcctccaggcctttcatctcatgacaaacaaatataataatgatatcgtgtcactctgttaaatgttcatactgtttcaagcccatatgattagatttatgtttttaaaatctgttgtctccatatcttgatggcttttgggagcatttcacacaaggatataaaatgcggttttcttaaatgaaatgttttgtagctagaataaaatcatttttacaagtacagcattcttggaaagaatttaacacccaaaaaggggaaaatgtaatgaaaaatctcaaggttggaaatacagccttactctctct

SEQ ID NO: 157825 - DNA, 1753 bp, Homo sapiens
  Payload ID: 10934
  Gene Symbol: NPR3
  Gene Name: natriuretic peptide receptor 3
  Uniprot ID: P17342
  ENST ID: ENST00000415167
  CDS Start-End: 55-1677
ggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccactttttttttttctgcctgagattctttaaggagatagacgggttgaaagacatcaatgaaac

SEQ ID NO: 157826 - DNA, 660 bp, Homo sapiens
  Payload ID: 10934
  Gene Symbol: NPR3
  Gene Name: natriuretic peptide receptor 3
  ENST ID: ENST00000507141
  CDS Start-End: 1-265
cgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagttttaggtcttatctgttggaatcccagtggaagaaaattctcttcttgatcattctactgcctgttaaccacacatgcaagctttctttccagtcatctttccaatatggttgtgccaaaatttttctcagtaggctgaggcaggaggattgcttgagtccaagagtttgaggctatggattgccctatttgaatagccactgcattccagcctgggcaacatagctagaccccatctcttacacaatattttttagttagttcagtattcagtataaatattatcattactttctaaatgatatttaaggttaagtcacataggcttctatgttgacatttccttttttccccctacctattttccttggagttaaaacagtctgtttttgtttatttgcttaatttcctatggatttataattaaataatcttctaattctt

SEQ ID NO: 157827 - DNA, 774 bp, Homo sapiens
  Payload ID: 10934
  Gene Symbol: NPR3
  Gene Name: natriuretic peptide receptor 3
  ENST ID: ENST00000509104
  CDS Start-End: 18-774
cttctttgcgtggcagcatggcagagggatgtgctgtgtacggaacctggccctggggagggatgttccagctgttccggccttctgcccttgctggcctctgctccataggactggtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcat

SEQ ID NO: 157828 - DNA, 1155 bp, Homo sapiens
  Payload ID: 10935
  Gene Symbol: NCR1
  Gene Name: natural cytotoxicity triggering receptor 1
  ENST ID: ENST00000291890
  CDS Start-End: 39-953
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtccaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgag

SEQ ID NO: 157829 - DNA, 973 bp, Homo sapiens
  Payload ID: 10935
  Gene Symbol: NCR1
  Gene Name: natural cytotoxicity triggering receptor 1
  ENST ID: ENST00000338835
  CDS Start-End: 8-871
ctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtccaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctgaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactg

SEQ ID NO: 157830 - DNA, 739 bp, Homo sapiens
  Payload ID: 10935
  Gene Symbol: NCR1
  Gene Name: natural cytotoxicity triggering receptor 1
  Uniprot ID: O76036
  ENST ID: ENST00000350790
  CDS Start-End: 8-637
ctgagcgatgtcttccacactccctgccctgctctgcgtcgggctgtgtctgagtcagaggatcagcgcccagcagcaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactg

SEQ ID NO: 157831 - DNA, 594 bp, Homo sapiens
  Payload ID: 10935
  Gene Symbol: NCR1
  Gene Name: natural cytotoxicity triggering receptor 1
  Uniprot ID: O76036
  ENST ID: ENST00000357397
  CDS Start-End: 1-594
atgtcttccacactccctgccctgctctgcgtcgaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttga

SEQ ID NO: 157832 - DNA, 996 bp, Homo sapiens
  Payload ID: 10935
  Gene Symbol: NCR1
  Gene Name: natural cytotoxicity triggering receptor 1
  ENST ID: ENST00000598576
  CDS Start-End: 33-908
ctgctcagcactaggccggcagaatctgagcgatgtcttccacactccctgccctgctctgcgtcgagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtccaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctgacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacgga

SEQ ID NO: 157833 - DNA, 1612 bp, Homo sapiens
  Payload ID: 10935
  Gene Symbol: NCR1
  Gene Name: natural cytotoxicity triggering receptor 1
  ENST ID: ENST00000594765
  CDS Start-End: 26-937
gcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtccaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctgacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagacagagttttctcttgttgcccaggctggagtgcaatggcgcgatcttggctcactgcaacctctagctctccatccctcgggagaatcgcttgaacctgggaggcggaggttgcggtgagccaaaatcgtgccactgcactccagcctgggcgacagagcgagactccatctcaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactagtgaacagtgaataaatggttgtatattcctaataagaaaaaaaaaaaaaaagacccaaagtacagcgagctgatgccgatctcatttcgcagaggtccgcctgctctcccctctccaagagtgtaatcctatgcttaataaacttatgccgctttgcta

SEQ ID NO: 157834 - DNA, 688 bp, Homo sapiens
  Payload ID: 10935
  Gene Symbol: NCR1
  Gene Name: natural cytotoxicity triggering receptor 1
  Uniprot ID: O76036
  ENST ID: ENST00000621652
  CDS Start-End: 8-586
ctgagcgatgtcttccacactccctgccctgctctgcgtcgggctgtgtctgagtcagaggatcagcgcccagcagcaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactg

SEQ ID NO: 157835 - DNA, 678 bp, Homo sapiens
  Payload ID: 10935
  Gene Symbol: NCR1
  Gene Name: natural cytotoxicity triggering receptor 1
  ENST ID: ENST00000616747
  CDS Start-End: 33-678
ctgctcagcactaggccggcagaatctgagcgatgtcttccacactccctgccctgctctgcgtcgagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtccaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctg

SEQ ID NO: 157836 - DNA, 720 bp, Homo sapiens
  Payload ID: 10935
  Gene Symbol: NCR1
  Gene Name: natural cytotoxicity triggering receptor 1
  ENST ID: ENST00000611233
  CDS Start-End: 39-720
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtccaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctg

SEQ ID NO: 157837 - DNA, 678 bp, Homo sapiens; identical to SEQ ID NO: 157835
  Payload ID: 10935
  Gene Symbol: NCR1
  Gene Name: natural cytotoxicity triggering receptor 1
  ENST ID: ENST00000619741
  CDS Start-End: 33-678

SEQ ID NO: 157838 - DNA, 707 bp, Homo sapiens
  Payload ID: 10935
  Gene Symbol: NCR1
  Gene Name: natural cytotoxicity triggering receptor 1
  ENST ID: ENST00000622620
  CDS Start-End: 26-707
gcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtccaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctg

SEQ ID NO: 157839 - DNA, 404 bp, Homo sapiens
  Payload ID: 10935
  Gene Symbol: NCR1
  Gene Name: natural cytotoxicity triggering receptor 1
  ENST ID: ENST00000611120
  CDS Start-End: 8-404
ctgagcgatgtcttccacactccctgccctgctctgcgtcgggctgtgtctgagtcagaggatcagcgcccagcagcaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctg

SEQ ID NO: 157840 - DNA, 996 bp, Homo sapiens
  Payload ID: 10935
  Gene Symbol: NCR1
  Gene Name: natural cytotoxicity triggering receptor 1
  ENST ID: ENST00000611318
  CDS Start-End: 33-908
ctgctcagcactaggccggcagaatctgagcgatgtcttccacactccctgccctgctctgcgtcgagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacgga

SEQ ID NO: 157841 - DNA, 1628 bp, Homo sapiens
  Payload ID: 10935
  Gene Symbol: NCR1
  Gene Name: natural cytotoxicity triggering receptor 1
  Uniprot ID: O76036
  ENST ID: ENST00000615622
  CDS Start-End: 39-953
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagacagagttttctcttgttgcccaggctggagtgcaatggcgcgatcttggctcactgcaacctctagctctccatccctcgggagaatcgcttgaacctgggaggcggaggttgcggtgagccaaaatcgtgccactgcactccagcctgggcgacagagcgagactccatctcaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactagtgaacagtgaataaatggttgtatattcctaataagaaaaaaaaaaaaaaagacccaaagtacagcgagctgatgccgatctcatttcgcagaggtccgcctgctctcccctctccaagagtgtaatcctatgcttaataaacttatgccgctttgcta

SEQ ID NO: 157842 - DNA, 689 bp, Homo sapiens
  Payload ID: 10935
  Gene Symbol: NCR1
  Gene Name: natural cytotoxicity triggering receptor 1
  ENST ID: ENST00000611792
  CDS Start-End: 8-689
ctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtccaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctg

SEQ ID NO: 157843 - DNA, 1161 bp, Homo sapiens
  Payload ID: 10935
  Gene Symbol: NCR1
  Gene Name: natural cytotoxicity triggering receptor 1
  ENST ID: ENST00000611561
  CDS Start-End: 39-953
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagacagag

SEQ ID NO: 157844 - DNA, 720 bp, Homo sapiens; identical to SEQ ID NO: 157836
  Payload ID: 10935
  Gene Symbol: NCR1
  Gene Name: natural cytotoxicity triggering receptor 1
  ENST ID: ENST00000614976
  CDS Start-End: 39-720

SEQ ID NO: 157845 - DNA, 1102 bp, Homo sapiens
  Payload ID: 10935
  Gene Symbol: NCR1
  Gene Name: natural cytotoxicity triggering receptor 1
  ENST ID: ENST00000614638
  CDS Start-End: 39-902
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttg

SEQ ID NO: 157846 - DNA, 361 bp, Homo sapiens
  Payload ID: 10935
  Gene Symbol: NCR1
  Gene Name: natural cytotoxicity triggering receptor 1
  ENST ID: ENST00000611122
  CDS Start-End: 1-361
atgtcttccacactccctgccctgctctgcgtcgaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccacagagggacataccgatgttttggctcctataacaaccatgcctggtctttccccagtgagccagtgaagctcctggtcacaggcgacattgagaacaccagccttgcacctgaagaccccacctttcctg

SEQ ID NO: 157847 - DNA, 594 bp, Homo sapiens
  Payload ID: 10935
  Gene Symbol: NCR1
  Gene Name: natural cytotoxicity triggering receptor 1
  Uniprot ID: O76036
  ENST ID: ENST00000611098
  CDS Start-End: 1-594
atgtcttccacactccctgccctgctctgcgtcgaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttga

SEQ ID NO: 157848 - DNA, 404 bp, Homo sapiens; identical to SEQ ID NO: 157839
  Payload ID: 10935
  Gene Symbol: NCR1
  Gene Name: natural cytotoxicity triggering receptor 1
  ENST ID: ENST00000612194
  CDS Start-End: 8-404

SEQ ID NO: 157849 - DNA, 594 bp, Homo sapiens; identical to SEQ ID NO: 157847
  Payload ID: 10935
  Gene Symbol: NCR1
  Gene Name: natural cytotoxicity triggering receptor 1
  Uniprot ID: O76036
  ENST ID: ENST00000616677
  CDS Start-End: 1-594

SEQ ID NO: 157850 - DNA, 1102 bp, Homo sapiens; identical to SEQ ID NO: 157845
  Payload ID: 10935
  Gene Symbol: NCR1
  Gene Name: natural cytotoxicity triggering receptor 1
  ENST ID: ENST00000619679
  CDS Start-End: 39-902

SEQ ID NO: 157851 - DNA, 720 bp, Homo sapiens; identical to SEQ ID NO: 157836
  Payload ID: 10935
  Gene Symbol: NCR1
  Gene Name: natural cytotoxicity triggering receptor 1
  ENST ID: ENST00000616780
  CDS Start-End: 39-720

SEQ ID NO: 157852 - DNA, 1161 bp, Homo sapiens; identical to SEQ ID NO: 157843
  Payload ID: 10935
  Gene Symbol: NCR1
  Gene Name: natural cytotoxicity triggering receptor 1
  ENST ID: ENST00000612403
  CDS Start-End: 39-953

SEQ ID NO: 157853 - DNA, 594 bp, Homo sapiens; identical to SEQ ID NO: 157847
  Payload ID: 10935
  Gene Symbol: NCR1
  Gene Name: natural cytotoxicity triggering receptor 1
  ENST ID: ENST00000615207
  CDS Start-End: 1-594

SEQ ID NO: 157854 - DNA, 868 bp, Homo sapiens
  Payload ID: 10935
  Gene Symbol: NCR1
  Gene Name: natural cytotoxicity triggering receptor 1
  ENST ID: ENST00000612577
  CDS Start-End: 39-668
tccccactgctcagcactaggccggcagaatctgagcgatgtcttccacactccctgccctgctctgcgtcgggctgtgtctgagtcagaggatcagcgcccagcagcaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttg

SEQ ID NO: 157855 - DNA, 720 bp, Homo sapiens; identical to SEQ ID NO: 157836
  Payload ID: 10935
  Gene Symbol: NCR1
  Gene Name: natural cytotoxicity triggering receptor 1
  ENST ID: ENST00000617741
  CDS Start-End: 39-720

SEQ ID NO: 157856 - DNA, 1102 bp, Homo sapiens; identical to SEQ ID NO: 157845
  Payload ID: 10935
  Gene Symbol: NCR1
  Gene Name: natural cytotoxicity triggering receptor 1
  ENST ID: ENST00000617861
  CDS Start-End: 39-902

SEQ ID NO: 157857 - DNA, 1161 bp, Homo sapiens; identical to SEQ ID NO: 157843
  Payload ID: 10935
  Gene Symbol: NCR1
  Gene Name: natural cytotoxicity triggering receptor 1
  ENST ID: ENST00000621792
  CDS Start-End: 39-953

SEQ ID NO: 157858 - DNA, 1102 bp, Homo sapiens; identical to SEQ ID NO: 157845
  Payload ID: 10935
  Gene Symbol: NCR1
  Gene Name: natural cytotoxicity triggering receptor 1
  Uniprot ID: O76036
  ENST ID: ENST00000617304
  CDS Start-End: 39-902

SEQ ID NO: 157859 - DNA, 594 bp, Homo sapiens; identical to SEQ ID NO: 157847
  Payload ID: 10935
  Gene Symbol: NCR1
  Gene Name: natural cytotoxicity triggering receptor 1
  Uniprot ID: O76036
  ENST ID: ENST00000613135
  CDS Start-End: 1-594

SEQ ID NO: 157860 - DNA, 594 bp, Homo sapiens; identical to SEQ ID NO: 157847
  Payload ID: 10935
  Gene Symbol: NCR1
  Gene Name: natural cytotoxicity triggering receptor 1
  ENST ID: ENST00000621164
  CDS Start-End: 1-594

SEQ ID NO: 157861 - DNA, 361 bp, Homo sapiens; identical to SEQ ID NO: 157846
  Payload ID: 10935
  Gene Symbol: NCR1
  Gene Name: natural cytotoxicity triggering receptor 1
  ENST ID: ENST00000613253
  CDS Start-End: 1-361

SEQ ID NO: 157862 - DNA, 978 bp, Homo sapiens
  Payload ID: 10935
  Gene Symbol: NCR1
  Gene Name: natural cytotoxicity triggering receptor 1
  ENST ID: ENST00000618585
  CDS Start-End: 12-890
gaatctgagcgatgtcttccacactccctgccctgctctgcgtcgagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacgga

SEQ ID NO: 157863 - DNA, 1161 bp, Homo sapiens; identical to SEQ ID NO: 157843
  Payload ID: 10935
  Gene Symbol: NCR1
  Gene Name: natural cytotoxicity triggering receptor 1
  ENST ID: ENST00000615717
  CDS Start-End: 39-953

SEQ ID NO: 157864 - DNA, 678 bp, Homo sapiens; identical to SEQ ID NO: 157835
  Payload ID: 10935
  Gene Symbol: NCR1
  Gene Name: natural cytotoxicity triggering receptor 1
  ENST ID: ENST00000616589
  CDS Start-End: 33-678

SEQ ID NO: 157865 - DNA, 404 bp, Homo sapiens; identical to SEQ ID NO: 157839
  Payload ID: 10935
  Gene Symbol: NCR1
  Gene Name: natural cytotoxicity triggering receptor 1
  ENST ID: ENST00000614704
  CDS Start-End: 8-404

SEQ ID NO: 157866 - DNA, 1102 bp, Homo sapiens; identical to SEQ ID NO: 157845
  Payload ID: 10935
  Gene Symbol: NCR1
  Gene Name: natural cytotoxicity triggering receptor 1
  ENST ID: ENST00000620757
  CDS Start-End: 39-902

SEQ ID NO: 157867 - DNA, 678 bp, Homo sapiens; identical to SEQ ID NO: 157835
  Payload ID: 10935
  Gene Symbol: NCR1
  Gene Name: natural cytotoxicity triggering receptor 1
  ENST ID: ENST00000614280
  CDS Start-End: 33-678

SEQ ID NO: 157868 - DNA, 975 bp, Homo sapiens
  Payload ID: 10935
  Gene Symbol: NCR1
  Gene Name: natural cytotoxicity triggering receptor 1
  ENST ID: ENST00000620906
  CDS Start-End: 12-887
gaatctgagcgatgtcttccacactccctgccctgctctgcgtcgagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacgga

SEQ ID NO: 157869 - DNA, 739 bp, Homo sapiens
  Payload ID: 10935
  Gene Symbol: NCR1
  Gene Name: natural cytotoxicity triggering receptor 1
  Uniprot ID: O76036
  ENST ID: ENST00000612645
  CDS Start-End: 8-637
ctgagcgatgtcttccacactccctgccctgctctgcgtcgggctgtgtctgagtcagaggatcagcgcccagcagcaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactg

SEQ ID NO: 157870 - DNA, 689 bp, Homo sapiens; identical to SEQ ID NO: 157842
  Payload ID: 10935
  Gene Symbol: NCR1
  Gene Name: natural cytotoxicity triggering receptor 1
  ENST ID: ENST00000620721
  CDS Start-End: 8-689

SEQ ID NO: 157871 - DNA, 1102 bp, Homo sapiens; identical to SEQ ID NO: 157845
  Payload ID: 10935
  Gene Symbol: NCR1
  Gene Name: natural cytotoxicity triggering receptor 1
  ENST ID: ENST00000617973
  CDS Start-End: 39-902

SEQ ID NO: 157872 - DNA, 1612 bp, Homo sapiens
  Payload ID: 10935
  Gene Symbol: NCR1
  Gene Name: natural cytotoxicity triggering receptor 1
  Uniprot ID: O76036
  ENST ID: ENST00000612239
  CDS Start-End: 26-937
gcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagacagagttttctcttgttgcccaggctggagtgcaatggcgcgatcttggctcactgcaacctctagctctccatccctcgggagaatcgcttgaacctgggaggcggaggttgcggtgagccaaaatcgtgccactgcactccagcctgggcgacagagcgagactccatctcaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactagtgaacagtgaataaatggttgtatattcctaataagaaaaaaaaaaaaaaagacccaaagtacagcgagctgatgccgatctcatttcgcagaggtccgcctgctctcccctctccaagagtgtaatcctatgcttaataaacttatgccgctttgcta

SEQ ID NO: 157873 - DNA, 1161 bp, Homo sapiens; identical to SEQ ID NO: 157843
  Payload ID: 10935
  Gene Symbol: NCR1
  Gene Name: natural cytotoxicity triggering receptor 1
  ENST ID: ENST00000616307
  CDS Start-End: 39-953

SEQ ID NO: 157874 - DNA, 361 bp, Homo sapiens; identical to SEQ ID NO: 157846
  Payload ID: 10935
  Gene Symbol: NCR1
  Gene Name: natural cytotoxicity triggering receptor 1
  ENST ID: ENST00000616564
  CDS Start-End: 1-361

SEQ ID NO: 157875 - DNA, 1155 bp, Homo sapiens
  Payload ID: 10935
  Gene Symbol: NCR1
  Gene Name: natural cytotoxicity triggering receptor 1
  Uniprot ID: O76036
  ENST ID: ENST00000617154
  CDS Start-End: 39-953
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgag

SEQ ID NO: 157876 - DNA, 720 bp, Homo sapiens; identical to SEQ ID NO: 157836
  Payload ID: 10935
  Gene Symbol: NCR1
  Gene Name: natural cytotoxicity triggering receptor 1
  ENST ID: ENST00000618798
  CDS Start-End: 39-720

SEQ ID NO: 157877 - DNA, 594 bp, Homo sapiens; identical to SEQ ID NO: 157847
  Payload ID: 10935
  Gene Symbol: NCR1
  Gene Name: natural cytotoxicity triggering receptor 1
  Uniprot ID: O76036
  ENST ID: ENST00000613556
  CDS Start-End: 1-594

SEQ ID NO: 157878 - DNA, 868 bp, Homo sapiens; identical to SEQ ID NO: 157854
  Payload ID: 10935
  Gene Symbol: NCR1
  Gene Name: natural cytotoxicity triggering receptor 1
  ENST ID: ENST00000620921
  CDS Start-End: 39-668

SEQ ID NO: 157879 - DNA, 720 bp, Homo sapiens; identical to SEQ ID NO: 157836
  Payload ID: 10935
  Gene Symbol: NCR1
  Gene Name: natural cytotoxicity triggering receptor 1
  ENST ID: ENST00000615309
  CDS Start-End: 39-720

SEQ ID NO: 157880 - DNA, 594 bp, Homo sapiens; identical to SEQ ID NO: 157847
  Payload ID: 10935
  Gene Symbol: NCR1
  Gene Name: natural cytotoxicity triggering receptor 1
  ENST ID: ENST00000615651
  CDS Start-End: 1-594

SEQ ID NO: 157881 - DNA, 1371 bp, Homo sapiens
  Payload ID: 10935
  Gene Symbol: NCR1
  Gene Name: natural cytotoxicity triggering receptor 1
  Uniprot ID: O76036
  ENST ID: ENST00000617784
  CDS Start-End: 39-953
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagacagagcgacagagcgagactccatctcaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactggtgaacagtgaataaatggttgtatattcctaataagaaaaaaaaaaaa

SEQ ID NO: 157882 - DNA, 1612 bp, Homo sapiens
  Payload ID: 10935
  Gene Symbol: NCR1
  Gene Name: natural cytotoxicity triggering receptor 1
  Uniprot ID: O76036
  ENST ID: ENST00000619451
  CDS Start-End: 26-937
gcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagacagagttttctcttgttgcccaggctggagtgcaatggcgcgatcttggctcactgcaacctctagctctccatccctcgggagaatcgcttgaacctgggaggcggaggttgcggtgagccaaaatcgtgccactgcactccagcctgggcgacagagcgagactccatctcaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactggtgaacagtgaataaatggttgtatattcctaataagaaaaaaaaaaaaaaagacccaaagtacagcgagctgatgccgatctcatttcgcagaggtccgcctgctctcccctctccaagagtgtaatcctctgcttaataaacttatgccgctttgcta

SEQ ID NO: 157883 - DNA, 868 bp, Homo sapiens; identical to SEQ ID NO: 157854
  Payload ID: 10935
  Gene Symbol: NCR1
  Gene Name: natural cytotoxicity triggering receptor 1
  ENST ID: ENST00000620180
  CDS Start-End: 39-668

SEQ ID NO: 157884 - DNA, 868 bp, Homo sapiens; identical to SEQ ID NO: 157854
  Payload ID: 10935
  Gene Symbol: NCR1
  Gene Name: natural cytotoxicity triggering receptor 1
  Uniprot ID: O76036
  ENST ID: ENST00000612384
  CDS Start-End: 39-668

SEQ ID NO: 157885 - DNA, 594 bp, Homo sapiens; identical to SEQ ID NO: 157847
  Payload ID: 10935
  Gene Symbol: NCR1
  Gene Name: natural cytotoxicity triggering receptor 1
  ENST ID: ENST00000613294
  CDS Start-End: 1-594

SEQ ID NO: 157886 - DNA, 739 bp, Homo sapiens; identical to SEQ ID NO: 157869
  Payload ID: 10935
  Gene Symbol: NCR1
  Gene Name: natural cytotoxicity triggering receptor 1
  Uniprot ID: O76036
  ENST ID: ENST00000611105
  CDS Start-End: 8-637

SEQ ID NO: 157887 - DNA, 868 bp, Homo sapiens; identical to SEQ ID NO: 157854
  Payload ID: 10935
  Gene Symbol: NCR1
  Gene Name: natural cytotoxicity triggering receptor 1
  ENST ID: ENST00000622270
  CDS Start-End: 39-668

SEQ ID NO: 157888 - DNA, 1027 bp, Homo sapiens
  Payload ID: 10935
  Gene Symbol: NCR1
  Gene Name: natural cytotoxicity triggering receptor 1
  Uniprot ID: O76036
  ENST ID: ENST00000610621
  CDS Start-End: 28-942
cagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccac

SEQ ID NO: 157889 - DNA, 973 bp, Homo sapiens
  Payload ID: 10935
  Gene Symbol: NCR1
  Gene Name: natural cytotoxicity triggering receptor 1
  Uniprot ID: O76036
  ENST ID: ENST00000618973
  CDS Start-End: 8-871
ctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactg

SEQ ID NO: 157890 - DNA, 973 bp, Homo sapiens; identical to SEQ ID NO: 157889
  Payload ID: 10935
  Gene Symbol: NCR1
  Gene Name: natural cytotoxicity triggering receptor 1
  Uniprot ID: O76036
  ENST ID: ENST00000611942
  CDS Start-End: 8-871

SEQ ID NO: 157891 - DNA, 678 bp, Homo sapiens; identical to SEQ ID NO: 157835
  Payload ID: 10935
  Gene Symbol: NCR1
  Gene Name: natural cytotoxicity triggering receptor 1
  ENST ID: ENST00000616389
  CDS Start-End: 33-678

SEQ ID NO: 157892 - DNA, 707 bp, Homo sapiens; identical to SEQ ID NO: 157838
  Payload ID: 10935
  Gene Symbol: NCR1
  Gene Name: natural cytotoxicity triggering receptor 1
  ENST ID: ENST00000612994
  CDS Start-End: 26-707

SEQ ID NO: 157893 - DNA, 594 bp, Homo sapiens; identical to SEQ ID NO: 157847
  Payload ID: 10935
  Gene Symbol: NCR1
  Gene Name: natural cytotoxicity triggering receptor 1
  ENST ID: ENST00000613768
  CDS Start-End: 1-594

SEQ ID NO: 157894 - DNA, 973 bp, Homo sapiens; identical to SEQ ID NO: 157889
  Payload ID: 10935
  Gene Symbol: NCR1
  Gene Name: natural cytotoxicity triggering receptor 1
  Uniprot ID: O76036
  ENST ID: ENST00000620296
  CDS Start-End: 8-871

SEQ ID NO: 157895 - DNA, 1161 bp, Homo sapiens; identical to SEQ ID NO: 157843
  Payload ID: 10935
  Gene Symbol: NCR1
  Gene Name: natural cytotoxicity triggering receptor 1
  Uniprot ID: O76036
  ENST ID: ENST00000619067
  CDS Start-End: 39-953

SEQ ID NO: 157896 - DNA, 1371 bp, Homo sapiens
  Payload ID: 10935
  Gene Symbol: NCR1
  Gene Name: natural cytotoxicity triggering receptor 1
  Uniprot ID: O76036
  ENST ID: ENST00000619077
  CDS Start-End: 39-953
tccccactgctcagcactaggccggcagaatctgagcgatgtcttccacactccctgccctgctctgcgtcgggctgtgtctgagtcagaggatcagcgcccagcagcagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggcgacattgagaacaccagccttgcacctgaagaccccacctttcctgcagacacttggggcacctaccttttaaccacagagacgggactccagaaagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagacagagcgacagagcgagactccatctcaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactagtgaacagtgaataaatggttgtatattcctaataagaaaaaaaaaaaa

SEQ ID NO: 157897 - DNA, 361 bp, Homo sapiens; identical to SEQ ID NO: 157846
  Payload ID: 10935
  Gene Symbol: NCR1
  Gene Name: natural cytotoxicity triggering receptor 1
  ENST ID: ENST00000622541
  CDS Start-End: 1-361

SEQ ID NO: 157898 - DNA, 739 bp, Homo sapiens; identical to SEQ ID NO: 157869
  Payload ID: 10935
  Gene Symbol: NCR1
  Gene Name: natural cytotoxicity triggering receptor 1
  Uniprot ID: O76036
  ENST ID: ENST00000610753
  CDS Start-End: 8-637

SEQ ID NO: 157899 - DNA, 1027 bp, Homo sapiens; identical to SEQ ID NO: 157888
  Payload ID: 10935
  Gene Symbol: NCR1
  Gene Name: natural cytotoxicity triggering receptor 1
  Uniprot ID: O76036
  ENST ID: ENST00000612896
  CDS Start-End: 28-942

SEQ ID NO: 157900 - DNA, 868 bp, Homo sapiens; identical to SEQ ID NO: 157854
  Payload ID: 10935
  Gene Symbol: NCR1
  Gene Name: natural cytotoxicity triggering receptor 1
  ENST ID: ENST00000617145
  CDS Start-End: 39-668

SEQ ID NO: 157901 - DNA, 688 bp, Homo sapiens; identical to SEQ ID NO: 157834
  Payload ID: 10935
  Gene Symbol: NCR1
  Gene Name: natural cytotoxicity triggering receptor 1
  Uniprot ID: O76036
  ENST ID: ENST00000621059
  CDS Start-End: 8-586

SEQ ID NO: 157902 - DNA, 404 bp, Homo sapiens; identical to SEQ ID NO: 157839
  Payload ID: 10935
  Gene Symbol: NCR1
  Gene Name: natural cytotoxicity triggering receptor 1
  ENST ID: ENST00000621993
  CDS Start-End: 8-404

SEQ ID NO: 157903 - DNA, 404 bp, Homo sapiens; identical to SEQ ID NO: 157839
  Payload ID: 10935
  Gene Symbol: NCR1
  Gene Name: natural cytotoxicity triggering receptor 1
  ENST ID: ENST00000618725
  CDS Start-End: 8-404

SEQ ID NO: 157904 - DNA, 1154 bp, Homo sapiens
  Payload ID: 10936
  Gene Symbol: NCR2
  Gene Name: natural cytotoxicity triggering receptor 2
  Uniprot ID: O95944
  ENST ID: ENST00000373083
  CDS Start-End: 223-999
agcccaccagacccagactcacctacagctggagatccccacttccctgtgcccacagaatctgccctttgcagtctcccatctccccaacccaggcctcagcctgtctcatttttctatcagacgtgctggaagagcagcagaatcaggcccagctcccaattccctctccccagtcttctccaggtgtcccctcccatgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagacctcctggactccccgcgacctggtctcttcacagacccagacccagagctgtgtgcctcccactgcaggagccagacaagcccctgagtctccatctaccatccctgtcccttcacagccacagaactccacgctccgccctggccctgcagcccccattgccctggtgcctgtgttctgtggactcctcgtagccaagagcctggtgctgtcagccctgctcgtctggtgggttttaaggaatcggcacatgcagcatcaagggaggtctctgctgcacccagctcagcccaggccccaggcccatagacacttcccactgagccacagggcaccaggggggacatatggtggaaaaccatgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacact

SEQ ID NO: 157905 - DNA, 1000 bp, Homo sapiens
  Payload ID: 10936
  Gene Symbol: NCR2
  Gene Name: natural cytotoxicity triggering receptor 2
  Uniprot ID: O95944
  ENST ID: ENST00000373086
  CDS Start-End: 27-839
ccatgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagacctcctggactccccgcgacctggtctcttcacagacccagacccagagctgtgtgcctcccactgcaggagccagacaagcccctgagtctccatctaccatccctgtcccttcacacccgtcctctccccttcctgtccctctgccttccaggccacagaactccacgctccgccctggccctgcagcccccattgccctggtgcctgtgttctgtggactcctcgtagccaagagcctggtgctgtcagccctgctcgtctggtgggttttaaggaatcggcacatgcagcatcaagggaggtctctgctgcacccagctcagcccaggccccaggcccatagacacttcccactgagccacagggcaccaggggggacatatggtggaaaaccatgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtga

SEQ ID NO: 157906 - DNA, 942 bp, Homo sapiens
  Payload ID: 10936
  Gene Symbol: NCR2
  Gene Name: natural cytotoxicity triggering receptor 2
  Uniprot ID: O95944
  ENST ID: ENST00000373089
  CDS Start-End: 89-919
gagcagcagaatcaggcccagctcccaattccctctccccagtcttctccaggtgtcccctcccatgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagacctcctggactccccgcgacctggtctcttcacagacccagacccagagctgtgtgcctcccactgcaggagccagacaagcccctgagtctccatctaccatccctgtcccttcacagccacagaactccacgctccgccctggccctgcagcccccattgccctggtgcctgtgttctgtggactcctcgtagccaagagcctggtgctgtcagccctgctcgtctggtggggggacatatggtggaaaaccatgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttt

SEQ ID NO: 157907 - DNA, 1042 bp, Homo sapiens
  Payload ID: 10937
  Gene Symbol: NCR3
  Gene Name: natural cytotoxicity triggering receptor 3
  Uniprot ID: O14931
  ENST ID: ENST00000340027
  CDS Start-End: 265-870
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtga

SEQ ID NO: 157908 - DNA, 541 bp, Homo sapiens
  Payload ID: 10937
  Gene Symbol: NCR3
  Gene Name: natural cytotoxicity triggering receptor 3
  Uniprot ID: O14931
  ENST ID: ENST00000376071
  CDS Start-End: 29-526
cccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagac

SEQ ID NO: 157909 - DNA, 875 bp, Homo sapiens
  Payload ID: 10937
  Gene Symbol: NCR3
  Gene Name: natural cytotoxicity triggering receptor 3
  Uniprot ID: O14931
  ENST ID: ENST00000376072
  CDS Start-End: 265-837
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagaccccaataaatctgccccaccact

SEQ ID NO: 157910 - DNA, 1097 bp, Homo sapiens
  Payload ID: 10937
  Gene Symbol: NCR3
  Gene Name: natural cytotoxicity triggering receptor 3
  Uniprot ID: O14931
  ENST ID: ENST00000376073
  CDS Start-End: 265-798
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatatgccaaatctactctctccggattcccccaactctgaactttcccttccaccaggtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtga

SEQ ID NO: 157911 - DNA, 875 bp, Homo sapiens; identical to SEQ ID NO: 157909
  Payload ID: 10937
  Gene Symbol: NCR3
  Gene Name: natural cytotoxicity triggering receptor 3
  Uniprot ID: O14931
  ENST ID: ENST00000383476
  CDS Start-End: 265-837

SEQ ID NO: 157912 - DNA, 1042 bp, Homo sapiens; identical to SEQ ID NO: 157907
  Payload ID: 10937
  Gene Symbol: NCR3
  Gene Name: natural cytotoxicity triggering receptor 3
  Uniprot ID: O14931
  ENST ID: ENST00000383477
  CDS Start-End: 265-870

SEQ ID NO: 157913 - DNA, 1097 bp, Homo sapiens; identical to SEQ ID NO: 157910
  Payload ID: 10937
  Gene Symbol: NCR3
  Gene Name: natural cytotoxicity triggering receptor 3
  Uniprot ID: O14931
  ENST ID: ENST00000383478
  CDS Start-End: 265-798

SEQ ID NO: 157914 - DNA, 541 bp, Homo sapiens; identical to SEQ ID NO: 157908
  Payload ID: 10937
  Gene Symbol: NCR3
  Gene Name: natural cytotoxicity triggering receptor 3
  Uniprot ID: O14931
  ENST ID: ENST00000400241
  CDS Start-End: 29-526

SEQ ID NO: 157915 - DNA, 1042 bp, Homo sapiens; identical to SEQ ID NO: 157907
  Payload ID: 10937
  Gene Symbol: NCR3
  Gene Name: natural cytotoxicity triggering receptor 3
  Uniprot ID: O14931
  ENST ID: ENST00000447248
  CDS Start-End: 265-870

SEQ ID NO: 157916 - DNA, 1097 bp, Homo sapiens
  Payload ID: 10937
  Gene Symbol: NCR3
  Gene Name: natural cytotoxicity triggering receptor 3
  Uniprot ID: O14931
  ENST ID: ENST00000455825
  CDS Start-End: 265-798
ccacaagctggccccttggcctcctagagaccctgacatctcctccagcagcatctgtcccctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatatgccaaatctactctctccggattcccccaactctgaactttcccttccaccaggtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtga

SEQ ID NO: 157917 - DNA, 875 bp, Homo sapiens
  Payload ID: 10937
  Gene Symbol: NCR3
  Gene Name: natural cytotoxicity triggering receptor 3
  Uniprot ID: O14931
  ENST ID: ENST00000412603
  CDS Start-End: 265-837
ccacaagctggccccttggcctcctagagaccctgacatctcctccagcagcatctgtcccctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagaccccaataaatctgccccaccact

SEQ ID NO: 157918 - DNA, 1042 bp, Homo sapiens
  Payload ID: 10937
  Gene Symbol: NCR3
  Gene Name: natural cytotoxicity triggering receptor 3
  Uniprot ID: O14931
  ENST ID: ENST00000435674
  CDS Start-End: 265-870
ccacaagctggccccttggcctcctagagaccctgacatctcctccagcagcatctgtcccctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgtctgacctggaaaggtccaagaaggcagctgccggctgtggtcccagcgcccctcccaccaccatgtgggagctcagcacatctgcttcccccagtcccaggaggctgagcctgattgtcctgagaaatgggaaggatcagatatgactcctccttggcaactgccctttcctgccaggcccacacataccctcttctggctgttaggggagcttgggtccctgaacactgtcattcacccaataaattactatttgaccccagagtgggtggaagggtga

SEQ ID NO: 157919 - DNA, 1097 bp, Homo sapiens; identical to SEQ ID NO: 157910
  Payload ID: 10937
  Gene Symbol: NCR3
  Gene Name: natural cytotoxicity triggering receptor 3
  Uniprot ID: O14931
  ENST ID: ENST00000433654
  CDS Start-End: 265-798

SEQ ID NO: 157920 - DNA, 1097 bp, Homo sapiens; identical to SEQ ID NO: 157910
  Payload ID: 10937
  Gene Symbol: NCR3
  Gene Name: natural cytotoxicity triggering receptor 3
  Uniprot ID: O14931
  ENST ID: ENST00000436253
  CDS Start-End: 265-798

SEQ ID NO: 157921 - DNA, 1042 bp, Homo sapiens; identical to SEQ ID NO: 157907
  Payload ID: 10937
  Gene Symbol: NCR3
  Gene Name: natural cytotoxicity triggering receptor 3
  Uniprot ID: O14931
  ENST ID: ENST00000437517
  CDS Start-End: 265-870

SEQ ID NO: 157922 - DNA, 875 bp, Homo sapiens; identical to SEQ ID NO: 157909
  Payload ID: 10937
  Gene Symbol: NCR3
  Gene Name: natural cytotoxicity triggering receptor 3
  Uniprot ID: O14931
  ENST ID: ENST00000441372
  CDS Start-End: 265-837

SEQ ID NO: 157923 - DNA, 874 bp, Homo sapiens
  Payload ID: 10937
  Gene Symbol: NCR3
  Gene Name: natural cytotoxicity triggering receptor 3
  Uniprot ID: O14931
  ENST ID: ENST00000418936
  CDS Start-End: 265-837
ccacaagctggccccttggcctcctagagaccctgacatctcctccagcagcatctgtcctctctcctcagggaggcaagcatttgatgctcgaggtccctggcagttgtggtccttggcaagtgatgtgtgagtcccgtgtgtcataggaagctccccatccccatctggtgaccaaaggcctggctacaagtagtgagtccttcctcctccacccagacctcactgctcagatccccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggaggtgctgggccttggtgtcgggacagggaatgggactcggctggtggtggagaaagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagaccccaataaatctgccccaccac

SEQ ID NO: 157924 - DNA, 874 bp, Homo sapiens; identical to SEQ ID NO: 157923
  Payload ID: 10937
  Gene Symbol: NCR3
  Gene Name: natural cytotoxicity triggering receptor 3
  Uniprot ID: O14931
  ENST ID: ENST00000452296
  CDS Start-End: 265-837

SEQ ID NO: 157925 - DNA, 875 bp, Homo sapiens; identical to SEQ ID NO: 157909
  Payload ID: 10937
  Gene Symbol: NCR3
  Gene Name: natural cytotoxicity triggering receptor 3
  Uniprot ID: O14931
  ENST ID: ENST00000436623
  CDS Start-End: 265-837

SEQ ID NO: 157926 - DNA, 1042 bp, Homo sapiens; identical to SEQ ID NO: 157907
  Payload ID: 10937
  Gene Symbol: NCR3
  Gene Name: natural cytotoxicity triggering receptor 3
  Uniprot ID: O14931
  ENST ID: ENST00000420556
  CDS Start-End: 265-870

SEQ ID NO: 157927 - DNA, 541 bp, Homo sapiens; identical to SEQ ID NO: 157908
  Payload ID: 10937
  Gene Symbol: NCR3
  Gene Name: natural cytotoxicity triggering receptor 3
  Uniprot ID: O14931
  ENST ID: ENST00000419728
  CDS Start-End: 29-526

SEQ ID NO: 157928 - DNA, 1097 bp, Homo sapiens; identical to SEQ ID NO: 157910
  Payload ID: 10937
  Gene Symbol: NCR3
  Gene Name: natural cytotoxicity triggering receptor 3
  Uniprot ID: O14931
  ENST ID: ENST00000439584
  CDS Start-End: 265-798

SEQ ID NO: 157929 - DNA, 541 bp, Homo sapiens; identical to SEQ ID NO: 157908
  Payload ID: 10937
  Gene Symbol: NCR3
  Gene Name: natural cytotoxicity triggering receptor 3
  Uniprot ID: O14931
  ENST ID: ENST00000453657
  CDS Start-End: 29-526

SEQ ID NO: 157930 - DNA, 1097 bp, Homo sapiens; identical to SEQ ID NO: 157910
  Payload ID: 10937
  Gene Symbol: NCR3
  Gene Name: natural cytotoxicity triggering receptor 3
  Uniprot ID: O14931
  ENST ID: ENST00000432392
  CDS Start-End: 265-798

SEQ ID NO: 157931 - DNA, 1097 bp, Homo sapiens; identical to SEQ ID NO: 157910
  Payload ID: 10937
  Gene Symbol: NCR3
  Gene Name: natural cytotoxicity triggering receptor 3
  Uniprot ID: O14931
  ENST ID: ENST00000446756
  CDS Start-End: 265-798

SEQ ID NO: 157932 - DNA, 541 bp, Homo sapiens; identical to SEQ ID NO: 157908
  Payload ID: 10937
  Gene Symbol: NCR3
  Gene Name: natural cytotoxicity triggering receptor 3
  Uniprot ID: O14931
  ENST ID: ENST00000420485
  CDS Start-End: 29-526

SEQ ID NO: 157933 - DNA, 875 bp, Homo sapiens; identical to SEQ ID NO: 157909
  Payload ID: 10937
  Gene Symbol: NCR3
  Gene Name: natural cytotoxicity triggering receptor 3
  Uniprot ID: O14931
  ENST ID: ENST00000457547
  CDS Start-End: 265-837

SEQ ID NO: 157934 - DNA, 541 bp, Homo sapiens; identical to SEQ ID NO: 157908
  Payload ID: 10937
  Gene Symbol: NCR3
  Gene Name: natural cytotoxicity triggering receptor 3
  Uniprot ID: O14931
  ENST ID: ENST00000455448
  CDS Start-End: 29-526

SEQ ID NO: 157935 - DNA, 541 bp, Homo sapiens; identical to SEQ ID NO: 157908
  Payload ID: 10937
  Gene Symbol: NCR3
  Gene Name: natural cytotoxicity triggering receptor 3
  Uniprot ID: O14931
  ENST ID: ENST00000438663
  CDS Start-End: 29-526

SEQ ID NO: 157936 - DNA, 1042 bp, Homo sapiens; identical to SEQ ID NO: 157907
  Payload ID: 10937
  Gene Symbol: NCR3
  Gene Name: natural cytotoxicity triggering receptor 3
  Uniprot ID: O14931
  ENST ID: ENST00000430599
  CDS Start-End: 265-870

SEQ ID NO: 157937 - DNA, 541 bp, Homo sapiens; identical to SEQ ID NO: 157908
  Payload ID: 10937
  Gene Symbol: NCR3
  Gene Name: natural cytotoxicity triggering receptor 3
  Uniprot ID: O14931
  ENST ID: ENST00000419086
  CDS Start-End: 29-526

SEQ ID NO: 157938 - DNA, 1042 bp, Homo sapiens; identical to SEQ ID NO: 157907
  Payload ID: 10937
  Gene Symbol: NCR3
  Gene Name: natural cytotoxicity triggering receptor 3
  Uniprot ID: O14931
  ENST ID: ENST00000415123
  CDS Start-End: 265-870

SEQ ID NO: 157939 - DNA, 561 bp, Homo sapiens
  Payload ID: 10937
  Gene Symbol: NCR3
  Gene Name: natural cytotoxicity triggering receptor 3
  ENST ID: ENST00000463064
  CDS Start-End: 29-376
cccttcgccaactgggacatcttccgacatggcctggatgctgttgctcatcttgatcatggtccatccaggatcctgtgctctctgggtgtcccagccccctgagattcgtaccctggaaggatcctctgccttcctgccctgctccttcaatgccagccaagggagactggccattggctccgtcacgtggttccgagatgaggtggttccagggaaggaggtgaggaatggaaccccagagttcaggggccgcctggccccacttgcttcttcccgtttcctccatgaccaccaggctgagctgcacatccgggacgtgcgaggccatgacgccagcatctacgtgtgcagagtggagaacatcctcagctaggggctggtacagtcctcctccttcgggctggattctatgctgtcagctttctctctgtggccgtgggcagcaccgtctattaccagggcaaatgccactgtcacatgggaacacactgccactcctcagatgggccccgaggagtgattccagagcccagatgtccctagtcctcttcaaaagac

SEQ ID NO: 157940 - DNA, 561 bp, Homo sapiens; identical to SEQ ID NO: 157939
  Payload ID: 10937
  Gene Symbol: NCR3
  Gene Name: natural cytotoxicity triggering receptor 3
  ENST ID: ENST00000488139
  CDS Start-End: 29-376

SEQ ID NO: 157941 - DNA, 561 bp, Homo sapiens; identical to SEQ ID NO: 157939
  Payload ID: 10937
  Gene Symbol: NCR3
  Gene Name: natural cytotoxicity triggering receptor 3
  ENST ID: ENST00000493663
  CDS Start-End: 29-376

SEQ ID NO: 157942 - DNA, 561 bp, Homo sapiens; identical to SEQ ID NO: 157939
  Payload ID: 10937
  Gene Symbol: NCR3
  Gene Name: natural cytotoxicity triggering receptor 3
  ENST ID: ENST00000496945
  CDS Start-End: 29-376

SEQ ID NO: 157943 - DNA, 561 bp, Homo sapiens; identical to SEQ ID NO: 157939
  Payload ID: 10937
  Gene Symbol: NCR3
  Gene Name: natural cytotoxicity triggering receptor 3
  ENST ID: ENST00000480313
  CDS Start-End: 29-376

SEQ ID NO: 157944 - DNA, 561 bp, Homo sapiens; identical to SEQ ID NO: 157939
  Payload ID: 10937
  Gene Symbol: NCR3
  Gene Name: natural cytotoxicity triggering receptor 3
  ENST ID: ENST00000470666
  CDS Start-End: 29-376

SEQ ID NO: 157945 - DNA, 561 bp, Homo sapiens; identical to SEQ ID NO: 157939
  Payload ID: 10937
  Gene Symbol: NCR3
  Gene Name: natural cytotoxicity triggering receptor 3
  ENST ID: ENST00000465928
  CDS Start-End: 29-376

SEQ ID NO: 157946 - DNA, 6438 bp, Homo sapiens
  Payload ID: 10938
  Gene Symbol: NCR3LG1
  Gene Name: natural killer cell cytotoxicity receptor 3 ligand 1
  Uniprot ID: Q68D85
  ENST ID: ENST00000338965
  CDS Start-End: 245-1609
aaagtgcggcgcgggtggggctggtcacgcgcctggcttcctgcagtgcgaacctgggaaatccaggcgacttcgcagttgccgaagggatctgaagaagtgggatgtgcaaaagcgccggctggaaatcccggctgtgtctccgtcaactctttacgcaacagaggtctccccctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtggcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctgaaactgagaagacagataatttttccattcattggtggcctatttcattcattggtgttggactggttttattaattgttttgattccttggaaaaagatatgtaacaaatcatcttcagcctatactcctctcaagtgcattctgaaacactggaactcctttgacactcagactctgaagaaagagcacctcatattcttttgcactcgggcatggccgtcttaccagctgcaggatggggaggcttggcctcctgagggaagtgttaatattaatactattcaacaactagatgttttctgcagacaggagggcaaatggtccgaggttccttatgtgcaagccttctttgccttgcgagacaacccagatctttgtcagtgttgtagaattgaccctgctctcctaacagttacatcaggcaagtccatagatgataattccacaaagtctgagaaacaaacccctagggaacactcggatgcagttccggatgccccaatccttcctgtctcccctatctgggaacctcctccagccacaacatcaacaactccagttctatcctcccaacccccaactttactgttacccctacagtaaatgcctgatggacctggtgccactagggtccaagttcccttttcattacaggaccttgggcaaataagaggggacctgggcaagttctctgatgacctgatagatatatagaggctttccaaaacctaactcaggtgtttgaccttacttggggtgatgttatgttgctcttaaactcttaactactacagagaaacaggtagccctgcaggcagcagaaaaattcagagatgaacaacatgtcttctatagccactcaataaggaaagaaggtgagaaacaaccagcattcacatacccaataggaagcgaggcagtgccccttgaacaacataattcggaccccagtggtaccttagatgagtggcaaagaaaacattttcaaatgtgcttattagagggcctacagaggaccagagccaagcctcttaattaccccaaactctccatgatagatcaaaaactagatgaaaatccctcagcctttttggaaaggctgagagaggctgtagtgaaacacacttccttgtctcctgttaggtatgtttatacctcacataaataattcaattgagggacagctaattttgaaagacaagtttattactcagacagcccctgatatcagaaggaagctagagaaacaggccatgggattagatagcaccttacaaaacctcctgaaggtagccacctcggtcttttataatagggaccaggaggaggcccaggggaaggagaggaaacacaagaaaaaggcagagactctggtggccactttgtataaaacccagtatccccaaggtacacctgctagttgctaccaatgtggcaaactagggcacttcaaaagggactgcccaggcagcaagaagaagccacctcaaccctgtccagtatacaatggggaccactggaaggcagactgtcctgggaagcataggtcactgagtccagagccagtctcacaaatggtccagcaggactgatgggtcctggggctcaactccctggctccagtggctcagactgctgttactacccgggagcaccaggtgattctggagttcgaagggaggaaggtagacttctttctggacactggagccaggcttctgttttcctctccaattcaggccttcgttcctcccatagcacaaccatgatgggcatctcaggaaagactttaacttgatatttttctcaacctattagttgcagtcagagggacctactgtttacacaggcctttttagtcatgcctgaaagtcccactcctttattagatagagatattccagcacgtatgggggccaccatccttatggctccaggacaaactccgcctccccttagtggaaaccagtattaacccagaggtttgggcaactcagggaagaagtggccggactataaccactataccagtctggatccacctcaaggatcccactttttttcctaaccagagacaataccctctgaagccagaaagtagaaaagggctagacgccagcattgataacctaaaggcacaaggcctccttaggccttgcagtagcccttgaaacaccccaatattaggggtgcaaaaatccaatggggaagggagactagttcaggacctctgccttattcatgaggctgtgattacgattcatccagtagatcccagtccctatactttgctaactcaaatatccaagggaactaaatggttcacagttctgggcctaaaggatgcctttttctgtatacctttataccctgactcccaatacttgtttacctttgaagacccctccaatcaaaccacccagttaacctggactgtactgcctcagggatttagagatagcccccacctatttgggcaagtattgtcaagagatctcttcgaattcttccattctcaggttaaagttttacaatatgtagatgacattctcctctgtgccccaactgaggaagtttcttgagacggcactgaggctctccttaatttcctagctggaaagggatataaggcttcaaaatctaaggctcagctctatcagactttggtaaagtacctaggtctggtcttgtcagaagggaacaagagcactaggcgaggagaggattaatcccatttcctcccttcctctccccagaaccctcaagcagctgagggatgcttgggcattacaggtttttgtaggttatagatacccaggtatgataaaataggttgccctttatatcaccttataaaagaaattcaagtggctaaaactcacttcctgacctgggaacctgaaggtcaaaaggccattaatcagttaaaacaagccttgcttaaagcaccagcccccagtctttctgtagggaagtcctttaatctttatgtatcataaaggaaaggaatgaccctgggagttttaattcaagttcaaggcccagctcaacagccagtaggttacttaagtagagagcttgacttggaggctaaaggatggccagcttgcctctgagcagttacagtagtggccctgctagtcccagaggccaccaagttaaccctggggaataacctgtttatgcctcacataaataatgtggcaggcttgctgtcctctaaagcgagtctctggctaacagacagctgcctcctcaagtatcagactttgctgctagaggaatctgcagtccagttaaaaacctgaccttgcctgatcccagacactttcctcccagaggaaactggagaaactgaacataattgtgaacagactgtagtacaacctatgccgctagggaggatctcaaagaaattcccctagaaaatccagactggacccactttatggatgggagctcttttgtaggacagggagtctgaaaagtgggatatgcagtagtcaccctaaataacattgaaaatgtgcctctctcaccaggcacacacactcaatcagttgagctgatccctctcacaagagcacttgaactaagcaaaggaaagacagctaacatttatactgactccaagtgtacctttctagttctccttgcccatgctgccatctgaaaggaaaggcacttcctcaccgctaatgggtcttgcattaaataccatcaagacatcaacaggctattatcctcagtgttcctcccatgagaattagtggtcagacattgcagagggcatcagaagcgggtagatgaaatagcgaaaggaaacaggctagcagaccaaagagctaagtcagcagtaagaaggccccaaggtcccaaaacacttgaggcccctctgatttgggagggctacataagggaaataaagcctcagtattcccctacagagatagaatgggccacctctcgaggtatacttttcaaccctcaggatggttacaatcagaagattgcaaagtacgcttgccagcctccagccaatggaagattcttaaaatcctccactgagcctttcacttaggaaagcataagacatcagtgcatccaaagattgttctcaggagaaaatctactaaaaatggtcaaataggttgttaatactcgtgaaaccctcttaaaaataatccctttaacagatgacttcttccccaccacaatcaaaggatgggaagttactcaggggaggactggcagatagacttcacccatatgcccaaaataaatggcattcaatgtcttttggtgtgggtgcataccttcattaactgggtagaggcattcccatgcccaacagaaaaggcctctgaggtggtgagaatactaattagttaaataattcctcactttgggctccctaagtacttccaaaacaacaatggtccctcatttaaagaagcctctacccagtagggccgagtctgctaggactttttattgggtttggtaatacgtcacaccctttagcctctactgtgtcagccatgtcccatttatacaagacaaattgctgggtctgtcctgagcggtttgctcagttcagtaacactaaggaacctcttgatgacttggtatttactgtcttagcattccctttgttagctttacctttagccattaaagacttgtcaggcataaatggaacatggtatgggaacactttcaactgagtaactaactcctcccaggaaagcatttcctccctggtgccagaaaacactttccccaaagataagcctcacaccctcaggctaggaaaagttggccgggtaatagcaaatgcctcctcctgttttaaaagcagaggaaaaggaccatacctgggagatctcaaatattataacaccatacttgtaattgctgaaagctcggaagtttggagaaaaagacataagaaggatgatctaagaaaattggaagccatatggaggggaggctttcagaattcagcgtctcctcctggttgaaagtcctgctgggaatggcaggctctgggtaaccaccctgacacatggcactataatgtaaaaaacaacacataggccttcccagacatgcaccctcatgggattccagaccccctgtatgatgcttagtagtagtggcctacaaatctgtgggtgaacagaacaggagacttctggactgacagcccctgtcacaagggggcattatctgagatattggccagggcatatcgtgtccctggtcttttgaaactccatttgtcggccaggtgtggtggcttacgactgtaatcccagcactttgggaggctgaggcaggtagatgatgaggtcaggagttcaagactagcctggacaatatggtgaaaccccgtctgtactaataatacaaaaaaaaaaaaaaaaaaa

SEQ ID NO: 157947 - DNA, 2429 bp, Homo sapiens
  Payload ID: 10938
  Gene Symbol: NCR3LG1
  Gene Name: natural killer cell cytotoxicity receptor 3 ligand 1
  Uniprot ID: Q68D85
  ENST ID: ENST00000530403
  CDS Start-End: 72-1436
cctgcccttggtttctaccgggccgcctgctcccactcggcgaaaaaaattacacaacagcagccgcggcgatgacgtggagggctgccgcctccacgtgcgcggcgctcctgattctgctgtgggcgctgacgaccgaaggtgatctgaaagtagagatgatggcaggggggactcagatcacacccctgaatgacaatgtcaccatattctgcaatatcttttattcccaacccctcaacatcacgtctatgggtatcacctggttttggaagagtctgacgtttgacaaagaagtcaaagtctttgaattttttggagatcaccaagaggcattccgacctggagccattgtgtctccatggaggctgaagagtggggacgcctcactgcggctgcctggaatccagctggaggaagcaggagagtaccgatgtgaggtggtggtcacccctctgaaggcacagggaacagtccagcttgaagttgtggcttccccagccagcagattgttgctggatcaagtgggcatgaaagagaatgaagacaaatatatgtgtgagtcaagtgggttctacccagaggctattaatataacatgggagaagcagacccagaagtttccccatcccatagagatttctgaggatgtcatcactggtcccaccatcaagaatatggatggcacatttaatgtcactagctgcttgaagctgaactcctctcaggaagaccctgggactgtctaccagtgtgtggtacggcatgcgtccttgcatacccccttgaggagcaactttaccctgactgctgctcggcacagtctttctgaaactgagaagacagataatttttccattcattggtggcctatttcattcattggtgttggactggttttattaattgttttgattccttggaaaaagatatgtaacaaatcatcttcagcctatactcctctcaagtgcattctgaaacactggaactcctttgacactcagactctgaagaaagagcacctcatattcttttgcactcgggcatggccgtcttaccagctgcaggatggggaggcttggcctcctgagggaagtgttaatattaatactattcaacaactagatgttttctgcagacaggagggcaaatggtccgaggttccttatgtgcaagccttctttgccttgcgagacaacccagatctttgtcagtgttgtagaattgaccctgctctcctaacagttacatcaggcaagtccatagatgataattccacaaagtctgagaaacaaacccctagggaacactcggatgcagttccggatgccccaatccttcctgtctcccctatctgggaacctcctccagccacaacatcaacaactccagttctatcctcccaacccccaactttactgttacccctacagtaaatgcctgatggacctggtgccactagggtccaagttcccttttcattacaggaccttgggcaaataagaggggacctgggcaagttctctgatgacctgatagatatatagaggctttccaaaacctaactcaggtgtttgaccttacttggggtgatgttatgttgctcttaaactcttaactactacagagaaacaggtagccctgcaggcagcagaaaaattcagagatgaacaacatgtcttctatagccactcaataaggaaagaaggtgagaaacaaccagcattcacatacccaataggaagcgaggcagtgccccttgaacaacataattcggaccccagtggtaccttagatgagtggcaaagaaaacattttcaaatgtgcttattagagggcctacagaggaccagagccaagcctcttaattaccccaaactctccatgatagatcaaaaactagatgaaaatccctcagcctttttggaaaggctgagagaggctgtagtgaaacacacttccttgtctcctgttaggtatgtttatacctcacataaataattcaattgagggacagctaattttgaaagacaagtttattactcagacagcccctgatatcagaaggaagctagagaaacaggccatgggattagatagcaccttacaaaacctcctgaaggtagccacctcggtcttttataatagggaccaggaggaggcccaggggaaggagaggaaacacaagaaaaaggcagagactctggtggccactttgtataaaacccagtatccccaaggtacacctgctagttgctaccaatgtggcaaactagggcacttcaaaagggactgcccaggcagcaagaagaagccacctcaaccctgtccagtatacaatggggaccactggaaggcagactgtcctgggaagcataggtcactgagtccagagccagcttctgttttcctctccaattcaggccttc

SEQ ID NO: 157948 - DNA, 843 bp, Homo sapiens
  Payload ID: 10939
  Gene Symbol: NKG7
  Gene Name: natural killer cell granule protein 7
  Uniprot ID: Q16617
  ENST ID: ENST00000221978
  CDS Start-End: 181-678
aaaccagcctcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggctacatccacgtgacgcagaccttcagcattatggctgttctgtgggccctggtgtccgtgagcttcctggtcctgtcctgcttcccctcactgttccccccaggccacggcccgcttgtctcaaccaccgcagcctttgctgcagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcccacatctgcccgcccttccagcccttccccagcccctcctcttgtttcttcattcattcaacaaaatttggctggaatctggtta

SEQ ID NO: 157949 - DNA, 816 bp, Homo sapiens
  Payload ID: 10939
  Gene Symbol: NKG7
  Gene Name: natural killer cell granule protein 7
  ENST ID: ENST00000595217
  CDS Start-End: 167-595
tgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggccacggcccgcttgtctcaaccaccgcagcctttgctgcaggtaaggactctggactggactggggcatcgcgagccagcgaattcctgccgaggagctgagccatctctcttgtccttgtccccagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcccacatctgcccgcccttccagcccttccccagcccctcctcttgtttcttcattcattcaacaaaatttggctggaatctggttattttga

SEQ ID NO: 157950 - DNA, 520 bp, Homo sapiens
  Payload ID: 10939
  Gene Symbol: NKG7
  Gene Name: natural killer cell granule protein 7
  ENST ID: ENST00000600427
  CDS Start-End: 106-363
aaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctggtttgaggctgtgggtcccacccactcagctcactcgggcctctggccaacagggcatggggacatcatatcaggccacggcccgcttgtctcaaccaccgcagcctttgctgcaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcccacatctgcccgcccttccagcccttccccagcccctcctcttgtttcttcattcattcaacaaaatttggctggaa

SEQ ID NO: 157951 - DNA, 347 bp, Homo sapiens
  Payload ID: 10939
  Gene Symbol: NKG7
  Gene Name: natural killer cell granule protein 7
  ENST ID: ENST00000595157
  CDS Start-End: 1-268
ctggccaacagggcatggggacatcatatcaggccacggcccgcttgtctcaaccaccgcagcctttgctgcagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtc

SEQ ID NO: 157952 - DNA, 376 bp, Homo sapiens
  Payload ID: 10939
  Gene Symbol: NKG7
  Gene Name: natural killer cell granule protein 7
  ENST ID: ENST00000593572
  CDS Start-End: 1-219
acagggcatggggacatcatatcagccatctccatggtggtggccatggcggtgtacaccagcgagcggtgggaccagcctccacacccccagatccagaccttcttctcctggtccttctacctgggctgggtctcagctatcctcttgctctgtacaggtgccctgagcctgggtgctcactgtggcggtccccgtcctggctatgaaaccttgtgagcagaaggcaagagcggcaagatgagttttgagcgttgtattccaaaggcctcatctggagcctcgggaaagtctggtcccacatctgcccgcccttccagcccttccccagcccctcctcttgtttcttcattcattcaacaaaatttggctggaa

SEQ ID NO: 157953 - DNA, 7343 bp, Homo sapiens
  Payload ID: 10940
  Gene Symbol: NKTR
  Gene Name: natural killer cell triggering receptor
  Uniprot ID: P30414
  ENST ID: ENST00000232978
  CDS Start-End: 189-4577
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaagtctga

SEQ ID NO: 157954 - DNA, 646 bp, Homo sapiens
  Payload ID: 10940
  Gene Symbol: NKTR
  Gene Name: natural killer cell triggering receptor
  ENST ID: ENST00000442970
  CDS Start-End: 60-377
gctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagagaatgtggtcttttgcaaaatgaaaaggtaagagaacgaagctcagtaacacaaactccaattctgttcccttgcacccttcctaataaatttatggacagtctgggtcaggttgtggctggatttctatattgcttgaagacttggaaaattctgtgtattatttcatacatgcttctgtatcttttttcatttcccaatgggttattaatttcacatcagagaaaagagtctagttgtggggttttttttcccctaaaccaagcaatttctttgaataaaagttgaaatttcgttttt

SEQ ID NO: 157955 - DNA, 7325 bp, Homo sapiens
  Payload ID: 10940
  Gene Symbol: NKTR
  Gene Name: natural killer cell triggering receptor
  ENST ID: ENST00000429888
  CDS Start-End: 121-438
aggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagagaatgtggtcttttgcaaaatgaaaagatgaaaactttattctcaaacatgacagagcgttccttttatcaatggcaaatcgagggaaacataccaatggttcccagtttttcataaagagtgttacaccgtgcgctccaaagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaa

SEQ ID NO: 157956 - DNA, 560 bp, Homo sapiens
  Payload ID: 10940
  Gene Symbol: NKTR
  Gene Name: natural killer cell triggering receptor
  ENST ID: ENST00000445842
  CDS Start-End: 247-560
aggctggaggccagccaggtgaagagctcgcccgcatgcgtgcgcgctgcgtgggagccgcgaggcccggggcgggagggggcctcgtcttggcctcctgcgctgtcgcgacgggccggcgtgaggcaccgtggcgcggacttcgtctcagccccgccctcgcccctgccctcgcccccgccctcgcccctgccctgaccgcttttctccccctctctcccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagagaatgtggtcttttgcaaaatgaaaag

SEQ ID NO: 157957 - DNA, 7319 bp, Homo sapiens
  Payload ID: 10940
  Gene Symbol: NKTR
  Gene Name: natural killer cell triggering receptor
  ENST ID: ENST00000617821
  CDS Start-End: 1073-4561
gacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaaggtaaggcttaatatttttcttcaaacagatgaaaactttattctcaaacatgacagagcgttccttttatcaatggcaaatcgagggaaacataccaatggttcccagtttttcataaagagtgttacaccgtgcgctccaaagtaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtct

SEQ ID NO: 157958 - DNA, 918 bp, Homo sapiens
  Payload ID: 10941
  Gene Symbol: NCBP2-AS2
  Gene Name: NCBP2 antisense RNA 2 (head to head)
  Uniprot ID: Q69YL0
  ENST ID: ENST00000602845
  CDS Start-End: 95-394
gtcatcaagctgcgcgggggcatagacgtccgggtcgggcgccgcggggcggaagacgagggcggcgaggtcgggttccgggcgcttggagaagatggtgctgcggcggctgctggccgccctgctgcacagcccgcagctggtggaacgtctgtcagagtcgcggcctatccgacgtgcggcgcagctcacggccttcgcactgctgcaggcccagctgcggggccaggacgcggcccgccgcctgcaggacctcgcggctgggcccgtgggctccctgtgccgccgcgctgagcgatttagagacgccttcacccaggagctacgccgcggcctccgaggccgctcggggccaccaccaggtagccagaggggccctggcgcaaacatttaatcctgggctgtgcggggccgaggccgcttgcttttccttccgggctctacagtggcatcaatgtggaggggtcattccgggcactgcgcgcggcttcgaatcccgactgggattgttggcctgcagacatcccacgcataagagcctaggccagaccgcccgctccgttgaagtcttgtgattggacaagacacagtgtggagacagccctaagcctaacagagatgaaggtaggctgggtccagacacggcacctacggagagccacggaccgaagccagagagcctttcctctgcaagtgggactgaaactcttgacagatgctgctcaatctgactggtatagcaggacagttaattccagggacgatatggatgaaaagacaaccctacagctgccaaattcctttgattaaatgtgtgagctggttgataggcatgagtgtgatacttctcaggcaagatgtgttaagaataccggggactgtaggcctatggtaataataaacacgtattttatgaaa

SEQ ID NO: 157959 - DNA, 1937 bp, Homo sapiens
  Payload ID: 10942
  Gene Symbol: NCK1
  Gene Name: NCK adaptor protein 1
  Uniprot ID: P16333
  ENST ID: ENST00000288986
  CDS Start-End: 131-1264
accgcgcgtgccccgcctctctcccaagagctacgcggcggcggcggagcgcaggcctcgtgccgttacggccatcacggcggccgcagtggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 157960 - DNA, 1971 bp, Homo sapiens
  Payload ID: 10942
  Gene Symbol: NCK1
  Gene Name: NCK adaptor protein 1
  Uniprot ID: P16333
  ENST ID: ENST00000481752
  CDS Start-End: 165-1298
accgcgcgtgccccgcctctctcccaagagctacgcggcggcggcggagcgcaggcctcgtgccgttacggccatcacggcggccgcagtggcgtcctggagccctcctcaggtgagctggagctgcccggctcggcagcgggaagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttcca

SEQ ID NO: 157961 - DNA, 526 bp, Homo sapiens
  Payload ID: 10942
  Gene Symbol: NCK1
  Gene Name: NCK adaptor protein 1
  ENST ID: ENST00000488930
  CDS Start-End: 41-526
ggcgtcctggagccctcctcagtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtttggaaccatcacctccacagtgtgattacattaggccttcactcactggaaagtttgctggcaatccttggtattatggcaaagtca

SEQ ID NO: 157962 - DNA, 581 bp, Homo sapiens
  Payload ID: 10942
  Gene Symbol: NCK1
  Gene Name: NCK adaptor protein 1
  ENST ID: ENST00000467911
  CDS Start-End: 60-581
actgagaattatcctgagctgtgttaacaaactgacagaacacagaatttttactcaaaatggattggttaaacgtctttaaagattttttcagcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatat

SEQ ID NO: 157963 - DNA, 557 bp, Homo sapiens
  Payload ID: 10942
  Gene Symbol: NCK1
  Gene Name: NCK adaptor protein 1
  ENST ID: ENST00000476286
  CDS Start-End: 332-557
ctcgtgccgttacggccatcacggcggccgcagtggcgtcctggagccctcctcaggtgagctggagctgcccggctcggcagcgggaagagacagtctcactgtgttgcccaggctggttttgaactcctgcgctcaagtgatcttcccatctctgcctcccaaagagctaggattacaggagtgagccactgcacccagcagcttgatgtttctaaggttcatccatgttatagcacatactggtactgtgtctggaattggtgggttcttggtctctctgacttcaagaatgaagccgcggaccctcgcgtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttag

SEQ ID NO: 157964 - DNA, 587 bp, Homo sapiens
  Payload ID: 10942
  Gene Symbol: NCK1
  Gene Name: NCK adaptor protein 1
  ENST ID: ENST00000491539
  CDS Start-End: 201-587
aagagctacgcggcggcggcggagcgcaggcctcgtgccgttacggccatcacggcggccgcagtggcgtcctggagccctcctcagagatagggtctcactgtgttgttcagactggttttgaattcctggcctcaaacgatcctcccaccttggcttctcaacgtgctgggattatagggtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaag

SEQ ID NO: 157965 - DNA, 422 bp, Homo sapiens
  Payload ID: 10942
  Gene Symbol: NCK1
  Gene Name: NCK adaptor protein 1
  ENST ID: ENST00000496489
  CDS Start-End: 1-422
atgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaagtgtgattacattaggccttcactcactggaaagtttgctggcaatccttggtattatggcaaa

SEQ ID NO: 157966 - DNA, 2403 bp, Homo sapiens
  Payload ID: 10942
  Gene Symbol: NCK1
  Gene Name: NCK adaptor protein 1
  Uniprot ID: P16333
  ENST ID: ENST00000469404
  CDS Start-End: 92-1033
gtttcagtgttgcagaacagacgaggaagctcactgagaattatcctgagctgtgttaacaaactgacagaacacagaatttttactcaaaatggattggttaaacgtctttaaagattttttcagcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcgccaaatgatttctcagtatcactaaaagcacaagggaaaaacaagcattttaaagtccaactaaaagagactgtctactgcattgggcagcgtaaattcagcaccatggaagaacttgtagaacattacaaaaaggcaccaatttttacaagtgaacaaggagaaaaattatatcttgtcaagcatttatcatgatactgctgaccagaagtgactgctgtgtagctgtaatttgtcatgtaattgaagactgagaaaatgttgggtccagtcgtgcttgattggaaattgttgtttctaaatctatatgagaattgacaataagtatttttattataactcagcccatacatatatactatgtatgcagtgcatctgcatagaacagttccttatccttggccttctgttttattgtttttttctttgctgttttccctttgcttctaatattacagttttgtattttgtaaacaaaaatcaaataatgcatatcagaatctttatatggaagaaatcctttattgcctttcctttgtttccttgtaaaggcaccctgttctgttatggtttttcattatataaaattattatatctatatatgacatatgctaaaatttcttggagagtgttaatcttttctgtgactaaatagcaataataagtggaaaattagaaattatttccaggtattatatttgtcacaggccattgtaaataccaagtatattgtgtctgccataatttttaaaaatacattcattgtcttcagtcatacagcaagacacatgagacatagattagaaaacatgttgtacaattttaatttacaactgttggaaataaaaatcacttaatttttttccagtgcttctccctcatctggttattcaagaaaacaaaacagtctctgagatatttagcttttcaaactgtaaatagatgctctagtgttatttatttttttaatcccacttgtattattttacctctagagcatcttgtattaggacatgttatatttatgccagtgggaaataagttatggccaagttttgcaaaaacaggaagcagtgagatacttgtttttttctcctcactaaatatcagtaattgtcaggaatggtattacctattttcatttcctcttttcagctttaagttttgttgattgggacactaaaactgatgtatacctgaggaaaaaatagaatgtgctcatggttagggaaaattatattatttttaattttttaatttgttttttaaccaagtaggaatttgggtgtatggataagaggccaatctgcttctgtaggctatagaagaaaaccagttgtattttatggtcataatttgtccccctattattctggagatttaaatttaagtaaagtagccatcagtattttaattgaaaaatactaaagccacataactgagtaggatgtcgtatgatactttcaacaaattccctaatgctgcctaagcatatggatgttttaattctttgctgttataaatagatatctaatacgccagaattactgatggtaaaattgaa

SEQ ID NO: 157967 - DNA, 571 bp, Homo sapiens
  Payload ID: 10942
  Gene Symbol: NCK1
  Gene Name: NCK adaptor protein 1
  ENST ID: ENST00000485096
  CDS Start-End: 226-571
gcggcggcggcggagcgcaggcctcgtgccgttacggccatcacggcggccgcagtggcgtcctggagccctcctcaggtgagctggagctgcccggctcggcagcgggaagagatagggtctcactgtgttgttcagactggttttgaattcctggcctcaaacgatcctcccaccttggcttctcaacgtgctgggattatagggtgctgaagctgctgaaagatggcagaagaagtggtggtagtagccaaatttgattatgtggcccaacaagaacaagagttggacatcaagaagaatgagagattatggcttctggatgattctaagtcctggtggcgagttcgaaattccatgaataaaacaggttttgtgccttctaactatgtggaaaggaaaaacagtgctcggaaagcatctattgtgaaaaacctaaaggataccttaggcattggaaaagtgaaaagaaaacctagtgtgccagattctgcatctcctgctgatgatagttttgttgacccaggggaacgtctctatgacctcaacatgcccgcttatgtgaaattta

SEQ ID NO: 157968 - DNA, 2683 bp, Homo sapiens
  Payload ID: 10943
  Gene Symbol: NCK2
  Gene Name: NCK adaptor protein 2
  Uniprot ID: O43639
  ENST ID: ENST00000233154
  CDS Start-End: 443-1585
gccgcggggatcgtcaggccggagccgcgcggccgagcgggcggcgggcggaggggagggcttggcggccgggaggctcgcggcgcccgggccggcagggtccgcccgggccggcagcgtccgcccggcggcgggaggagggagcggcgcagacaaagagcggcgcctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaagg

SEQ ID NO: 157969 - DNA, 790 bp, Homo sapiens
  Payload ID: 10943
  Gene Symbol: NCK2
  Gene Name: NCK adaptor protein 2
  ENST ID: ENST00000393348
  CDS Start-End: 358-790
ggagcttttgtgcccggcttcaggctctgcgccctgccccagatttacaggactctaacagccacctgaatgaaccaaagtttctcacaatcgctcggctctctcggtttttttcagggcgatttaatcaccgagtgcttttggaaaaatttgatatatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgca

SEQ ID NO: 157970 - DNA, 2371 bp, Homo sapiens
  Payload ID: 10943
  Gene Symbol: NCK2
  Gene Name: NCK adaptor protein 2
  Uniprot ID: O43639
  ENST ID: ENST00000393349
  CDS Start-End: 133-1275
tggagtgaagtggtcgtttattggctggccctctgatatgaggtggtggtgaattggtgggcgtcagtgcagtaagtgagcgagccggacgtcgattgactggtcttcagaagcagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcgcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaa

SEQ ID NO: 157971 - DNA, 494 bp, Homo sapiens
  Payload ID: 10943
  Gene Symbol: NCK2
  Gene Name: NCK adaptor protein 2
  ENST ID: ENST00000425756
  CDS Start-End: 164-494
tggtgtgacttagtttttgattgctggatttcactggagtgaagtggtcgtttattggctggccctctgatatgaggtggtggtgaattggtgggcgtcagtgcagtaagtgagcgagccggacgtcgattgactggtcttcagaagcaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggcctcggcaagacgcgcaggaagaccagcgcgcgggatgcgtcccccacgcccagcacggacgccgagtaccccgccaatggcagcggcgccgaccgcatctacg

SEQ ID NO: 157972 - DNA, 1795 bp, Homo sapiens
  Payload ID: 10943
  Gene Symbol: NCK2
  Gene Name: NCK adaptor protein 2
  ENST ID: ENST00000451463
  CDS Start-End: 277-528
ctgggcgggcgcagcgcggccaccgccccgggacccgcgccgctgccctccggctccgcgggcggcccacggcgagatttcatgtgttctttgtatacaagcgacgtcccagattataattctctgctgagatttgagttggatttgaggatttggagaatccctgcagctttgtaacttcagaggtgtaattagctgaaaacatcatcgttttgaagagttctgcgttttgccagtcacctctcaactgtgtgccaaagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactagcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaagg

SEQ ID NO: 157973 - DNA, 490 bp, Homo sapiens
  Payload ID: 10943
  Gene Symbol: NCK2
  Gene Name: NCK adaptor protein 2
  ENST ID: ENST00000522586
  CDS Start-End: 70-321
tcatcgttttgaagagttctgcgttttgccagtcacctctcaactgtgtgccaaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactagcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtga

SEQ ID NO: 157974 - DNA, 2989 bp, Homo sapiens
  Payload ID: 10944
  Gene Symbol: NCKIPSD
  Gene Name: NCK interacting protein with SH3 domain
  Uniprot ID: Q9NZQ3
  ENST ID: ENST00000294129
  CDS Start-End: 121-2289
gcgcgcgcctgcgtagtgtgtcacggggcgggacaaccgcggcgcggctcggcgctcccggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 157975 - DNA, 2925 bp, Homo sapiens
  Payload ID: 10944
  Gene Symbol: NCKIPSD
  Gene Name: NCK interacting protein with SH3 domain
  Uniprot ID: Q9NZQ3
  ENST ID: ENST00000416649
  CDS Start-End: 78-2225
gcggctcggcgctcccggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 157976 - DNA, 725 bp, Homo sapiens
  Payload ID: 10944
  Gene Symbol: NCKIPSD
  Gene Name: NCK interacting protein with SH3 domain
  ENST ID: ENST00000413374
  CDS Start-End: 1-456
gacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaaggtgcctggagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccat

SEQ ID NO: 157977 - DNA, 803 bp, Homo sapiens
  Payload ID: 10944
  Gene Symbol: NCKIPSD
  Gene Name: NCK interacting protein with SH3 domain
  ENST ID: ENST00000415281
  CDS Start-End: 1-803
atcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggagcacctgggcacgcctttcgcccagttcctactgaacatcgtcgaggatgggctgcccttggacaccacagagcagctgccggacctctgcgtgaacctgcttctgg

SEQ ID NO: 157978 - DNA, 889 bp, Homo sapiens
  Payload ID: 10944
  Gene Symbol: NCKIPSD
  Gene Name: NCK interacting protein with SH3 domain
  ENST ID: ENST00000453349
  CDS Start-End: 279-889
gcactcggtgaagacaggtggtgaggcctagacacaccgagagccgggccccgcgggggcttccaagtgtcggatcagcaagatcatcctttcgaggtcgccgtccttgcaattagtagatgggacccactgccccagggcggtaggggcgcacccgctacgagcggagcgcgctttcaccgggaggtctaactgctgtcccctgccccccccagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctc

SEQ ID NO: 157979 - DNA, 1214 bp, Homo sapiens
  Payload ID: 10944
  Gene Symbol: NCKIPSD
  Gene Name: NCK interacting protein with SH3 domain
  ENST ID: ENST00000439518
  CDS Start-End: 29-1214
cttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggtgagggtgggcggcacagcagggccaccctgctacccaccctgttcccaccgtcacacacttgtccagcctgtacattacaggtatttctcaa

SEQ ID NO: 157980 - DNA, 998 bp, Homo sapiens
  Payload ID: 10944
  Gene Symbol: NCKIPSD
  Gene Name: NCK interacting protein with SH3 domain
  ENST ID: ENST00000454134
  CDS Start-End: 121-297
gcgcgcgcctgcgtagtgtgtcacggggcgggacaaccgcggcgcggctcggcgctcccggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcaggtctaactgctgtcccctgccccccccagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcc

SEQ ID NO: 157981 - DNA, 897 bp, Homo sapiens
  Payload ID: 10944
  Gene Symbol: NCKIPSD
  Gene Name: NCK interacting protein with SH3 domain
  ENST ID: ENST00000426678
  CDS Start-End: 401-897
ccggcactcggtgaagacaggtggtgaggcctagacacaccgagagccgggccccgcgggggcttccaagtgtcggatcagcaagatcatcctttcgaggtcgccgtccttgcaattagtagatgggacccactgccccagggcggtaggggcgcacccgctacgagcggagcgcgctttcaccgggagggcctggagcaggatgtcctccaggccattgaccgggccatcgaggctgtacacaacacagccatgcgggatggtggcaagtacagcctggaacagcgtggagtcctccagtgagtgttgaggggagtgaagtgggacctcccggaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctc

SEQ ID NO: 157982 - DNA, 4989 bp, Homo sapiens
  Payload ID: 10945
  Gene Symbol: NCKAP1
  Gene Name: NCK-associated protein 1
  Uniprot ID: Q9Y2A7
  ENST ID: ENST00000360982
  CDS Start-End: 760-4164
gcggcgagcgcctgtcaagcagtgggaggaaaaagcgcttggagccaccagcccactcttaagcgaaactcgcctggaaaacaccccgcctcccagcagagtttctgccggtttctttagaagggtggtgcggaaaagcaacttttgggaacttgaaggagtggggtgtggggcgaagtggaaagagcacacaacgcgaccccactcagtccccgcttgggactcccatcccggcatcaggcgtagtgggcggtccgggccagggccagggccagagcggcggcggcgaggccatgccgagggcccgtcggccgcagttccccgtccggcctcgcgggggcgccggcgctgccgatcaggtgaccgagggcccgtccggggctgcgggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaagcaaggacaagtttggaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggaccatgtttgtgaattgctgaatactattgacgtttgccaagtcttctttgatattactgtaaactttgatttaacaaagaactacttagatttaattataacctatacaacactaatgatactgctgtctcgaattgaagaaaggaaggcaatcattggattatacaactatgcccatgaaatgactcatggagcaagtgacagagaatacccacgccttggccagatgattgtggattatgaaaaccctttaaagaagatgatggaagaatttgtaccccatagcaagtctctttcagatgcactaatttctcttcaaatggtatatcctcgaaggaatctttcagctgaccagtggagaaatgcccagttattgagcctcatcagtgcacctagtacaatgcttaatccagcacagtccgacactatgccttgtgaatacctctctttggatgcaatggaaaagtggattatctttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggaggcagccgtgtcacatgctggttcaatgcacagagaaagacgcaagtttttaagatctgcactgaaggaattggctactgtcctctctgatcaacctggattgctaggtcccaaggcactttttgtttttatggcattatcctttgcccgtgatgaaatcatctggctacttcgtcatgcagataacatgccaaagaagagtgcagacgactttatagataagcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttgcacagaacagtgtacccttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtcttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagtattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtacctgccataacataaaataaacactagactgtatcacacttcgattga

SEQ ID NO: 157983 - DNA, 20347 bp, Homo sapiens
  Payload ID: 10945
  Gene Symbol: NCKAP1
  Gene Name: NCK-associated protein 1
  Uniprot ID: Q9Y2A7
  ENST ID: ENST00000361354
  CDS Start-End: 374-3760
ggaagcggcctcgttctcagccgccggagacgccgccgccgccgccgccgccgccacacctagtggagcagccggggaaggcggctcgttgggggctggggcggagagcgccgggggtgggggcggaagggcggcgggcggaaggcaggaggctgccggggcgcgggctgctgcgggagaaggggctccgaggagtccgccgcggctcgctctgtcgccggcgcgggattggggcgcgagggccatgggcgcgctctcctaaggcggaggtcgcgggcgggaggggaggaggcccgagagaggctgctgcgaaggccgcgggcccgtgactgggcgcgaggcggccggcggcggcggcggcaccagcaccaccatgtcgcgctcagtgctgcagcccagtcagcagaagctggcggagaagctcaccatcctcaacgaccggggcgtcggcatgctcacccgcctctacaacatcaagaaggcatgtggagaccccaaggcaaaaccatcctatcttatcgacaaaaacctggaatctgctgtgaaattcatagtcagaaaattccctgctgtagaaacccgcaacaacaatcaacagcttgcacaactacagaaagaaaaatcagagattctgaaaaatctggcattatattacttcacatttgtagatgttatggaatttaaggaccatgtttgtgaattgctgaatactattgacgtttgccaagtcttctttgatattactgtaaactttgatttaacaaagaactacttagatttaattataacctatacaacactaatgatactgctgtctcgaattgaagaaaggaaggcaatcattggattatacaactatgcccatgaaatgactcatggagcaagtgacagagaatacccacgccttggccagatgattgtggattatgaaaaccctttaaagaagatgatggaagaatttgtaccccatagcaagtctctttcagatgcactaatttctcttcaaatggtatatcctcgaaggaatctttcagctgaccagtggagaaatgcccagttattgagcctcatcagtgcacctagtacaatgcttaatccagcacagtccgacactatgccttgtgaatacctctctttggatgcaatggaaaagtggattatctttggctttattttgtgccatgggatcctaaatactgacgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggaggcagccgtgtcacatgctggttcaatgcacagagaaagacgcaagtttttaagatctgcactgaaggaattggctactgtcctctctgatcaacctggattgctaggtcccaaggcactttttgtttttatggcattatcctttgcccgtgatgaaatcatctggctacttcgtcatgcagataacatgccaaagaagagtgcagacgactttatagataagcacattgctgaattaatattttacatggaagaacttagagcacatgtgaggaaatacggacctgtaatgcagaggtattacgtgcagtacctttctggctttgatgctgttgtcctcaatgaactcgtgcagaatctttctgtttgccctgaagatgaatcaatcatcatgtcctcttttgttaacactatgacttccctaagtgtaaaacaagttgaagatggggaagtatttgatttcagaggaatgagattagattggtttaggttacaggcatatactagtgtctcaaaggcttcacttggccttgcagatcacagagaacttggaaagatgatgaatacaataatttttcatacaaaaatggtagattccttggtggaaatgttggtggaaacatcagatctctccatattttgtttttatagtcgtgcttttgagaagatgtttcaacagtgtttggagttaccctctcaatcaagatactcaattgcatttccactactttgcactcattttatgagttgcacgcatgaactatgtccagaagagcgacatcatattggagatcgcagtctttccttatgtaatatgttcctagatgaaatggccaaacaagctcgaaatctcatcactgatatttgcacagaacagtgtacccttagtgaccagttgctacccaagcattgtgccaaaactatcagtcaagcagtgaataagaaatcaaaaaagcagactggtaagaaaggggaacctgaaagggagaaaccaggtgttgagagcatgaggaaaaacaggctggttgtgaccaaccttgataaattgcacactgcactttctgagttatgcttctctataaattatgtaccaaacatggtggtatgggaacatacctttaccccacgagaatatttgacttctcatctggaaatacgctttaccaagtcaattgttgggatgactatgtataatcaagccacacaggaaattgcaaaaccttcagaacttctaacaagtgtaagagcatacatgaccgtactccagtcaatagaaaactatgtgcagattgatattacaagagtatttaataatgtgcttcttcaacaaacacaacatttagacagtcatggagagccaaccattacaagtctatacacaaattggtatttggaaactttgttacgacaagtcagcaatggccatatagcatattttcctgcaatgaaagcgtttgtgaacttacctacagaaaatgaattaacattcaatgcagaggaatattctgacatatcagaaatgaggtcattatcagaactactaggcccatatggtatgaagtttctaagtgaaagccttatgtggcatatttcatcacaagttgctgaacttaagaaacttgtggtggagaatgttgatgtgttaacacaaatgaggaccagctttgacaaaccagaccagatggctgcactgtttaaaagattatcatctgttgacagtgtcttgaagaggatgacaataattggtgtaattttatccttccgatcattggcacaagaagcacttagagatgtcttatcctaccacattccttttcttgtaagttcaattgaagattttaaggatcacattccaagggaaactgatatgaaggttgcaatgaatgtgtatgagttatcatcagctgccggattaccttgtgagattgatcctgcattggtcgtagctctttcttcacaaaaatcggaaaacattagtccagaagaagagtataaaattgcctgccttctcatggtgtttgtggcagtttctttgccaacactggccagtaatgtgatgtctcagtacagccctgctatagaagggcattgcaacaacatacattgcttggccaaagccatcaaccagattgctgcagctttgtttacaattcacaaaggaagcattgaagaccgtcttaaagaatttctggcgcttgcatcctccagtctactgaaaattggccaggagacagataaaactacaacaagaaatagagaatctgtttatttactgctagatatgattgtacaagaatctccattccttacaatggatcttttggaatcttgttttccttatgtcttgctgagaaatgcataccatgctgtctacaaacaaagtgttacatcttctgcataaaattacctacttaatcaagataagcacgcatttttgttgccttggttttacctgtagactgtggaactattttaccttaagacctgaaaaagttttgtggattataaatttctttcatacggttgtattttctgatcattggtttcttaatatggttgtactacagtatacttggttgatttaggttgcacattcactgaattcactgagattattcctataattttaaagtatcatttatttgaaaaacatacattatcaacatgtttttgatatttgataatgaaaaaaatctttgcttgtttatttctgaaaaagaactgtatttagtgattattttagatagtgatattatagtattcatctgtgtgtaaattatttcatatagggaagagttctgatctgtacctatggttcttattgaaaacaacattggatgtgcatttctgtgatgttatgaatacatttctactttattttgaaacatttgccaaactaaatactgtaacactgtataacatttaaaaatgttaaagaactgcttagtattagaagcagatcatttcccaaaattctaagagcagcagcatatgttgttgcttgtataaagcctagcgataatttttagactaacttccatggtgccctgttggcattagcactaccattgtaccctgctgtataataaacaatcttagacatttatcaactgttgatacaaatgttagtccctaaccactttttatatatgttttaaatttttgaaattcaagtgtacctgccataacataaaataaacactagactgtatcacacttcgattgatttctttaagatccttggatattcgttcaataataataaagtttttgtttaaacttagtttgaaatataaaaaataatggtttaggaatgtctaagtacagcattcgataccaggtcagctattatatgatttgtttaaatgttttaaaaaacattttattgaaaaaaataccaaaattagaaaataaaattacacaatacttcttaaaaattaagaacttaaagaaaacttgtatgctgtcaacttgctcattttatctgtaaccaaatagagttatttaaaagaatagggaaaaaaaattgagtgatcatgggactagtgagaatgttgagaactgctgcattagtcagtaatgaatgggaaagacataaaagggcctattgcttaatagttggcatggagggcaaagcagctcatttagtttgaaaactaacccaatgttttgctctttgattggcattgttgaggctgtttctcagcagctttgtatatgaatatcataaagagcttctgttcacagcttcttatgtatacactggtaacttgtgttaagataaaagaaggctgctgtgaactcagttataatgtttttctttcttcaaacatagagagtagaatgaaattgaagtactatgagattatgctattattttgtgtatgatttgtccagcctatatttaaagtagggagtagttgtcactatctgtcgaaaaattgtacttgttccataaagattttttaaaaagggaaattttaaaatggcatagttcagacctgaaatagtctgatttacacagtgagcagtcaaaactaagatttaatgccgtttgttttgaaatattaggatcttagagaggtaataactttgttggcagtgatctctggagaggtaaagtaggaatttggatatgtacactttggaatcatatgtgaaagggcataaggatgaaaataaggcattctctaccactgctaggctgagaaaaaaatcgctcctcatagtcacctgaagtttttgtccaaattttttctcatacagcaaaggcgggggaggaggcgtggcaaaggtaacttggaggaaaaagttaaaagtaaattgacaactactatttttaatatcttgtttgttttattttcttctaaacttacacaacaacatactatttttgttgttttctctacattaatgtgatcataccatacatactggcctgtaatctgcttatttcactcagtagtagaaaaaatgtctttaatattctttttaatacctttatagataccataactaatttaacaatttcatggccaggcgtagtggcacacgcctatttcagcactttgggaggccaaggcggatggatcacttgaggtcaggagttcaacaccagcctggccaacatggcaaaaccctgacactactaaaaatacaaaaattacccaggtatgatggtgcacacctatcatcctggctacatgggaggctgaggtggaagaattgtttgaacccggaaggaggaggttgctgtgagctgagatcacaccactgcactccagcctggatgacagaatgagactgtctcaaaaaaaaaaagaaaatactcatttggatagattggatagatttttagacaatttcttttcattattataaatgtatatctatatcttggtaaagttgacctgttatttttttagaataatttttcagaagtaaaattgcttcctttctgctgctttttcattcacttatttaagcaagtatttttagatgcctgcatgtaatggtgagcaaaaaggtgacccttttatagttgagcttggattttagtgatggtatacaataaacaaaccagcttcttgagacggagtttcactcttgttgcccaggaaatgggcaatggcctgatctcggctcactgtaacctccgcctcccgggttcaagcaattctcccatctcagcctcctgagtagctgagattacaggcgcccgccactacgcccagttaatttttggtatttttagtagagatggggttttaccatgttggccaggctggtctcgaactcctgacctcaggtgatccacccacctcagcctcccaaagtgctgggattacaggcatgagccaccacgcccagccatgagcaaacttctgatggtgactggaaagtatacaggataatgtggggaggcagtggtgaaactactttagaagaaagtgttagaagaaagtgtcatctgtgtaagagaaaacatttgagctggtacgtgaaggattagaaggaaccacaagtgggctgaggggaggaataataaaggcaaagacccagaaggcaagcacaaacttggcatgtttgagaagttagaagtgtgtcatctgtgtctctgtcatgaggagtgctcaagttccctctaggagccttatgggctatctagctctttttctcttctgatcatgtgcttgcttgctttcttctttgcttatatagcagagttcacaaattaaatctaatgtaggctggttaataaaggaaatgaacatgaattcactgataggctcttgcattaatgtgaaaatgtaaagtctgttgtacaccatcaggccttctaaatgaagcccaaattctgtaaggtagtgaattgtaacctactgattagtacatgatccatgcccattctgttataaggacttgcctttctgagacttcacctgtattattcctaagacttttgtgaataatccttaaagtagtgactccttacatctttctttcatttcttctttgtagtcacttgaaatgacagcatgaaccatcatttcatttgaaggcctgagcctgaattttcaaatagacaaaatgctctctttctccgaagatttgccatgacctctgcctttgggaaaaaatatttgagattttaaaatttttattctgtagtacaaaaattatgtttttcgttaattggtcctgtggaattggaaggaaatttaatatttattgactctactttggtattattttcagagtgagaagtaactttaagtgtattaaaatttcattcatttttgcatgaaccaaactttccctacacatcgctgtccttgactgtccagagtaaacatgtctaactctggaatgtttcatttccaataaaagtattcagcctgtcattttgggcctaagtaaaatgggataaattagcaatctgaagttaggatcctagccacagagggccatgtctcatttctggtttaagtgcacccctcatccccagcccttaccttcttctttctcttaaggattgagacaatcctcttggtgctcttggtgcaggtgcatcttggtcacctcttacatgagggccacaaacttggtaaatgggtggcctggagatggggttgtactaggtatgtgaccttggtgattgccttgtctcagttgtagtatatggctgagtcacattcatagtacactacatacacatactgaccaaatgccaatggctaaggcttgaaattatttcaccaagacctaaactgaagattaccatcataaaataagcttctagaatccatgaataagtaggaaatcatatttaaaatttactgtaattttattaaagctcattttttaaatttaatgcagtgcagagtcattaatttctcagcagtatcaggtgctaaattgctcactcattaaactactaatttaagatagttattttaaattatagaacaggaagcaacttacgaggttgcaaccaaattatatttattttttctccattagtaactgactaaaagtgttttcttcaactctgggatttgaagattttgtggtcagtggtgatataatttcactgaagcgtgctcacagactaaaactgtgcactactcagtgatgcgtcctgaatgttttcagagacaaacctaagataatgttgcccttgtttactttcattatttctgattttttttttatgcatgtgtttgctgcatcacacaattacttaagaagttgtccctaacctttgtgctgtggtctgaatgtttgtgtccccctggccacaaaattcatatgttgaaatctgatcatcagtgtgacaggatgtggggcctttgggaggtgattaggtcatgagagtggagccttcatgaatgggattaatgccctcgtaaaaggggccccagacagccgacttgccccaaccaccacgtgaggacaaagcaagaagccactgttcatgaaccagaaagcagaccctccacaaacaccaaatatgccagcacactgattggcttcccagcctccagaactataagcaagaagtttttttatagtaacaaatttattgttcacagttcttgcttataaactttataaaccagactaaggcatttcgttatagcagcccacacggactcatattttggttctagaaatgtgacactggaatgatgtggctctcaagatgacagtgttgcttctgaatgtctatgttcatgtcatctttaattgcatgaacaccagttttagcatcttcccttgagtagaaagagattctctacagcaagtattacgtaagaagtactggtggccaggcacagtggttcacgcctgtaatcccaacactttgagaggcggagccagaggtatcatttgagcctagaagttcgagagcagcctgggcaatatgtctaaaccccatctctacaaaaaaaatacaaaaatgaaaaagccgggtgtgattgtgtacacctgtagtcccagcaacttgagaagctgaggtggcaggattgcttgagcccaaggggagggttggcggcagtgggtggttcgaggctgcagtgagccatgattataccagtgcgctccagcctaggtgacagagcaagagccggtctcgataataattaaggccagacgcggtggctcactcctgtgatcccagcactttgggaggccaaggtggatggatcacctgaggtcaagagattgagaccaacctggccaacatggtgaaaccctgtctctactaaaaatacaaaaattagctgggctttgtggctcgcgcctgtaatcccagctactcaggaggctgaggcgggagaatcgcttgaacccaggaggcggagattgcagtgagccgagatcatgccactgcactccagcctgggcaacagaacaagactctgtctcaaaaaaaaaaaaaattataatacattaaaaaaaaaaagcacttgcattctgaaggcatattcacccttgaactgatagcattcaatgtataaaacacatgagtttcactccaagttacatatagaatgtttatctttatttgagaggaaatatccagttaataatcagaatgtcatactaattaggtatgaccataacttacgttagtcacatggtcattgattgcatgcagattctggctgccagaaagcacattgaagtaggtagtcatttaaccatttaactgttagatcttgcaaaggttgaagctgaagctgaggagcaggtagtacacaactttacaggttaatgctgaatgtcagttcattctgaattcttaccttcagccaaaaggtacaagggtctttgcagtctgaagcaaggcccagatggcagaacttgtgatggctaggaggggaaaatttgaccttaactggtagttgtggttttatcaagccaaaaatgctgactagaataataatgagagctaatgtttattgaaagcccattgtgtaccagatactctgttttctctaattcaaacctctaaatattgctcttttagtcttcacagtaatcctatatcatgatgacccccatttattgatatggaaactgaagctcaggaaagacaaagcaatttttacaaactcacactacaaggaagtagcagaggccaacatttaaatctggccccagagttgtgttcttctcattaaactgtgtctcagatctctcaaatgtgagtgtggacttttctaaccaatagcattttttaattaatgttttaaaaatttgaatagcttttagggtacagtgggtttttgtttacatggatgaatcatacattggtgaagtctgaggttttagtgtacctgtcacccaggtagtatgcattgtacccaatgtgtagttttttatccctagacccgttcccatcctcccacttctgagtctccaaagtccatgatatcactctgtatgcctttgcatacacatagcttagctcccacttacaagtgagaacatacggtatttggttttctgttcctgagttactttgcttagaataatggcctctggctccatcatagttgctgcaaaaagacattgtttctttttttatggctgaacagtattccgtggtgtgtatatataccacactttctttgtccactcattggtcagtgggcacttaggttggttccatatctttgcagttatgaattgtgctgcaataaatatacacatgcagattttttttgatatattgacttcctttgggtagatacccagtagtaggattgctggatcaaattctatccagtagcatttgaaactgctttacattaacaatgagggacaaaaaaaataacaatgagggcttacattatgctactcttgatactagacattttcatatccattacttcatttaaactccacaaccaaattactcaatagggattgttttctttatttttgtaaatgaatgtggaaaccagctcataaaactttaaattccttgccccagtgtcataaaattactgagtttgagtggcagtgctgagattaaaacctaaggctctaggatttccagcccatattttttctactgtatcatgttctttcccaaagcactaaaaaacatttcctgggtaaatgactgtgggcttggggacactatgcccactttctggccttcatgggtctaagttgcttctttgcttcttcactttttctctctgatcctgctcagattaatctctagtaaatcagatttctttcctaggctgtcttatcccacatatatagtagataatatgtcacatatttgtgaatgttaaaaatatttgttttagttttaaatctcaagctcacacagtacttactctctatgttaacaaaaatggtttttactattttctgaaggtaacgcagctgttgaagtgagatcctacactggaacatacaacacttggtctaatattaaagttcgtgccaagagctctctaaatgtgattgatggattaattctgcctttatgaaagatgaacttattttcaagataatagctaattcttgaatgggcaacctattatgtatcaatgattgtaatgatggagcattttagtcatttgtagctggaagagccttagagattatctggttcaacctattcaagagttaggtaatttaaccaaattaacatatgtggcgatgtgctcatatagtgttccttccactgtgctgtgttgccgcatatatgctgatcttatgtttatgcagtaatagtcttcataatgataaacagctactggttcctggtaggattttggacgtggatatgacttgaagtatgatgccacagcctcaaacaaatctggggtttgaatcccagctctgtcacttatggacaaattacttaacttctccaagtttgtttccctaagtgtagaatgtggataatatctactttaaagggctattgtaagcattaaaataagatcatgcgtataaattgatgagatggtggggaagaagaggctaccacaaagtaggcattcagtgtaaatggtggtagtttctccagtattattaggctatttggtttcacttataaaattgccttcaaagagttttttcatggcttttatgagtattataatatcagaacttccactcatgcaaatgtaacatttgtgtgttagtctattctatagctctgatcggagtctttatcttaaatgggaaagattattttccctgtcatgtaactttaacagaaaacgatgctaaaattaattttaagactgctctatactatatgtatgttatactatatttttatatactatacacaaaaatgtataagatgtaaagcttgtattttcaaatgttattgcagtatccagaacaattgcgacaattgctcttggaagcttctgtgcttttccacatgctgttccctgtctctggaatggaatgttctcttattctggctggcaaactcctgaacataatgtaaacagtaagctcaaacatcacttgccctttccttaccatgccatcctgtttcttctaaaccttataaatgcctttattatagtacatattgaatcataatgtaattattatttatctctgactcctttgattctgggactgccttgaggtcacggtctaggtttatttcatctttctgtctgtttagtcaaatttcctaccctgtgtaactctcagaatcttactttaagttaggaaaggccagtggctggacagatgctacagacctccattggtacagatgcccttagcttcatgttgggaacaagtggttctgtttctttttgttcctgtggagaagcatcagagatacaggcagctggggatttctacacctgtaatagcagcagctcagtgatgacacagagacatgttttttttttttttttttttttgacagaaggcgaaggggaagcaaggtacttcttacatggcagagggaaaaggagagttggagtgggggagggggagagggaggagcaggagcagggagacggggagggagaggaaactgccccgaagacatggtttctaagatttctcccaatgagacaaatcacttgtctgggatgtcagggggagaagatgcagaatctgagccccttgtataaatagacaaaaggtgaaagcattggcaatagatcaaaaaggcattccacgtagcaaaaaaattatttttaaatctgaaaatttaagtgaaatgccaagagcaaagaagagaggccatcagaaaaatttcaaagtgactactcaggtcattgtcctgaaataaatgatcattttattctggtgactcacccctagctagagtcagtacttcatagaaaagacaggagctgtgagacacttaactgtaatcttacccctttacagaaatgcctcctatagtcaagctggtctgatgatctcatgtcatcatgcacaaggattagcaagccttgaaattttatcctgtcagtgtaactcctcatctagtctcaagattgcactggcagttctttcgcagctgatcgtacagggaggaccaataaggctcatagaacacccttggagaatgaatgcctctgctgctggaggtcacagcacccagaaagtgactagagggagcagctgatacctgctctagtgagttgtgctattcctgtcacatccttgcagaggtccaagggttgctggcaagtgaaggaatatcatgcctgtagtttgaaggatagatcactcaactctcaactattctctcttcagctgtgaaccatacaacgtttttgaaaagcaaagtctgaacatttgcattctatacagaatattacagttggaaaataggtgtggtgtctagagaaatgcttctaaatgctgcaagccaccctatgtgaagcctagtctagaaatctgctttgcttcatttattaacttcattgtatctttggaagtagaagttcttaaaagtgtgtacagaagatgagtcctcagcatgagtttcactgcctgtctgtgtgagaggaagtgaccttgagagcagctgtagccctagggggacacccaggtagaggtgctcacaacatgctctgacacccggtatggctgcattcccagcttaaatgatcacatctgctcttggttttttcactgtttacaaaatctgatttctttaaagggaagggatggaaaaggtagtcaatgctcctctgagcacccaaagcatccctccacaagaacaaagaggaaaaatcattacttgctcccaacattacacaaagcgcatctctaccaatggaactctgcagtgtcggtctagccatcagcctttcccacctcacagcatattttctgtgggggtaatttattagaggggaatttgttcctttttactctttttactcttcaaattagtaatagaacccctcatgtcattctaagtgacttaagttttaaagggaaccagaaaaggagagaatatgctattgtggcacttctaaaatgcagagtgtcctcaaagatggttatagtgggtaatgggtttcatataaattgcatactagagtatctccatttcctcttttaattttttaattggttttttaaagcttgatatgctgagttagttttcatttaaaaacaatgcttgagtaggaaagttaaagaaatagaaattgcctgttttaatctattcatcctggcagcaggtatgtattgtatctgtccagagtccaaaacgtcagctccctccacttgccttccccatttcacataaactataaaagttagaaataatatattatgtcatatcctaacatcagttcaatgaatatagtttttaaaatacctactatgtgctagatactgaggacagaatgataaaatacaaaacaaagctaactaaaaacacagtttaactagtcttgtctacgattacctgccctaactataacttcatttaaggggagatactgctaaagggagttccttctgtgactgcacactctgataccaatatgtgacttctccctggctacaactgattaaatgagggaagaaaactgatccaaggggagttagtccaatagcttgtaaatggtgggttcttatcagagttttctcactaagttagaaccaagaggctgagggttgtgggggctacttaagcagaaagtttcatggagtatggactgtgcaccattgtgaagtttcctgtatttccacaggctgtgggggcagagagcatcagagtgctgatcaggaaaaaagaatgaggcagatgcagacagagaagcaaagaagcatgagaggatgagaattaggaagtagactcttttttcattttaattaatttgactagattatatttcttgcaatcaaaagggccctgtgcagagaaggtccttatcttcgttcattttttgttgctatagctgaatacccgagactgggtaatttataaagtaaagaaatttattgcttaccattttagatgctgggaagtacaaggtcaagggttctcatctagtgagggccttcttgctagtggggtctctgtagagtcctgaggtaacacagagcatcacatggtgtgggggtgggattcaccagagagagccaaactgacttttataacagactcacttttgtggtaactaacccactcccttgatagcccatcaatccattaatctagaaataaattcattcactcatgagggcagagctcttgtgaaccaatcacctcccagaagtcccacctctcaacactgctgcactggggaccaaatttccaacacatgaacttttcggggacacattcaagccacaacagtcctcaataaatatttgttgaatcaataaatacacaggacatagtgtcctaaatgcttggcatgtacatgaaccagatttggtccttgatgtcacagagcttataatatagtggaggagacagactttacatgtttgatcttgactgtaaaactagggtcactactcatcatctgatgaaggaggcagacagtaaaacaaataacaactattcaacatggtaacgtcaaaactgaacagaggctcaagtgaaagtttcaatgatagtaaccatggccaatggataggtgaatgcattggaaaattagtatgatgccattagcaaaaacataaattgcacttaactaaagttcatctggctgaattctttccttccttccttccttccttccttccttccttcctttcttcctctatctttctttggttttgagatctgtctatagtattgtgctagtgcacatattttaatttggtgcaaggcatgcttaacagagtaagtgaaaagctataaaggttagagcgtgtattagtttcaatgacgaaggagtaataaatcattttgtcaggttgcactctaacattcaaattccatttttattatggctaactagccaagcatttataattctgaactccacagaatggggaaaaagtgtattaacttataatagatcattgagcttgttaaatgtacctttcctaattcgtactttttcccttttgctgagaaaaatgcctttctgaatatataatttttacaggtcattggaaaggagtactgcacaacaggattattataatgtgctaaaagatggcacttgtatctcattgccacatagagagctcatgtgaaaactctttgatctttgctggctttttagctgaaaagatttggaaatctttttggcactggcaaaaacagaactgtggtaactgtttatagttggttgatttttagcaatgggtaagaatgtctttgttgaatccagtttattaatacgtaatgggcaacatgttgccttaaaggcaaaagcatatttttctcatatcaaaaagctccctaaatttttgccaatatccaaagatattttaagatggtcttcattttctttttcagtctgtcctatgctgagaaaaaaaaattacaacctctgaacttcagcagttttttaggtaaaaggaatttttcatgatgtgattgatataactactcagctggacataagctttcaagggctaagtccatttgccgatttgtttgcatttcctactccaactaaaataattcaaagacatgaagtgtctattgtggaaaatgcatgaataatgcaaaagtcattctcaagtgacctatcagaaaggcctaccagaaatgcagttactgctttctaataaaatcatgaaaaacttttttaaaaagtataaccatcttgaatttgttgaggcaattataagagagtatataagggcaagtttctccaaaagcggttctgtttgttttgtttttttttaataattcccatcaacagcaatctgttttctcattgtagtagtataggtgttaacataaaagctcaaacagcttgggagaaaaaaaaggatatagcaaacctaactgataactttgctagtttcaaatcattatgatggccattcatagatgactgaaatatttaacatttgaagtaacagaattttgacttatgttttcatggtttaagagtttatatttcaaattttttcacatagtctgtttataacagtatataaaacatgtattaactatataagttaataaagtcatgaactgatggccattttttggtcttattcatatagtataggctgttttgtgaattaatccccttcccatgtgtttgaattccccactatgtaaggcttagtggtgttagcatgatccaagggtgggattttcagccctctgacatcaaaaggtgaagcagaggacacaaaaaccctcactgcatcttccctagactggccagaaccactccatggtcagtggactcccttaataggaaggaatgctggtcagttgtcaaagagcaaaaagggaggggtagtcatgaggttggttgtaatcagaggtgcaacaggtctttccaaagggctggtttctgtttaactcttaggaaagaacacctaatggtagttagtgaggagggggtataatgagatgtgcccaacctcccatcccatcatggccgggaactcagtttttaaggtttccctgaagtcctcttggccaggagagggtctgtttagtcaaatgtggggggggagcttaggattttatttttatttccaagttataatgttggaccatcagagcatgaatacaggttgagtctttaatctgtaaatacttagcaatcaccttcttctcagtaactttctctgaaggttgctgataagccagtgttcttgatgtttgcccacttacccctcaagatgaggagtgaagaaattagattgcattgccaggaatttcctagaagaaaaggttttgaggatgcatgacctatgagggtgctgaggacccctttccaccaaacatggactaacttctgggttgctctttcacatctattgtcttgttcgacgtacacagaagtgcagagcacagccgcagccctcacagcatcatctatctaggttctgaatcctgaatggtctgaggctctcctagagctgagattctcctttgcagttccagtggagaaaagcactttctttgccgaggcagtgtaacttccttgttcccaaggctccaactgttgtgggcacatatgagtatacattaacatccatgcccaatttataatcactgttttccccacatgtgtactcagacctccaagcttctgaaaaatatttcctctcatctctcaaagaattttagtacatttgcctggatgcagaaacacaaatcatgctggctttcctactcaatcaaaaactgtagcttgagtggggtggcaagggttgtcccacagcaggtttacttggactccaaaatgatgtagagtttagtgaggcagctccttgagtttgaacttagagcccttttggctaccagggcacctgcagtcctccaagatagtagagtctgaaccagttaaagagccagctaccacagctttgcagaaaccactgtttctccttaactctagggctcagcggttgaactccttagaataaaactttctgtctgcgaccctatcattttcttttgtattttggccttcactgaattcccaccccatccattccaacagacttggttatacgtgtctgaacaccaaatgtgacagaatttgtggccttggatcaggaggctatttggcccttatctaaatcggtggctgagaatggattccagggaagtgtttttcttaggagtacccaagaagctcagctcaggttgggctccctgttctattctgagaactacaaatcaaattcaaaatggagcacagaaaattctcatttctagttgacttatttgtattttggtgtcctgtgccctaaatatcttctcaaggaaaccttggctttaaaagtgattgtttacttaaacaaataaaacaacaacatacaagaaaaggcagtaaatccgagcgtccatcaacaaatgaatcaaaaaacaaatgagatatatatgtacggtggcatattattcagccttaaaaaggaaagaaattttgacacatgagacaatatgaatgaaccttgaagacattaattatgctgagtgaaataagccagccacaaaagaacagatattgtataattcctcttatattaggtacctaaaatagtcaaattgatagaaagtagaatgttggttggcaggggctggcaaggagagggaaatgaagagaaggtgtatgaagggaacagagtttcagttggggaagacgaaaaagttctgacagtggatgatggtggttgttgcacagcaacatgaatgtacttaatgccacagaactgtatgcttaaaaatggttgaaacggtaaatttgatataatgtgtattgaacctatttccagatcaaaacagagagatctacattccttttggtggtgtcaaaataaaccattatcttgaaatagc

SEQ ID NO: 157984 - DNA, 9016 bp, Homo sapiens
  Payload ID: 10946
  Gene Symbol: NCKAP1L
  Gene Name: NCK-associated protein 1-like
  Uniprot ID: P55160
  ENST ID: ENST00000293373
  CDS Start-End: 80-3463
agagggtgtcaccatctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtacaagtatattttctatcttctggtgacttgagcttgagctctgacaggcatgggcctctccgaccttcatcactattcttaggataatgctggcgggcagagatgatcaatcatcatattaaatcataatgagcttataatcctcccactggagctgctattgtctcctgcacattcattaggaccattatcttctctcttcctttttcaaatgtgttcagcaaacattcaacctgctcctactgcagagtagcagcaaaggagcccctcttttcctttgtggggctcttcgaggggtcattgggtctcttcctttgcccccagcttgactgcgtttcctactggggcaaggaggaagtgcccttcagagatgttcactgcccacctactctactacattgtttgttacaagttctctcttgctttaacccctcctgctttgatatctccacaacccagagcagagggtcagttagtctccgtcaattctaggttacatgacaactgattggcccagacttaggtgggttttccctcctgtaccatttgggggtactctgccttttattgggagggactaatttaaccccaaatccttttgtcagcctgggtatagctgttgctccaggaagggatttctcttctggatcttaaatttcacagacctcattaggttgtatggccctgagagtgggtatccttgagggagtacaagctgtttcaacttagcccttttctgcgctaattagaatttcaagcgtcacagagcctgggggctttcaagatagcactaaactaggtttacttaactccttggcaggaaatagtggcccccatgcatcacttctgtgaatccactgccagggagaagtggagaaacagatcatatatgtcacaggtctagagtggttggaattgacaaatataattagctagttggttaattagggtcatgtccatactttcatgatgaaagggaagcagttgtcggttttcagcaaaaacgattcagccttcctgaagcctatttgatagctgttttggggttttgtacatgtgtttgctttttatttcttgagacccaggcttagtcaatactttcttaacttggcacccataatcaacatacagatttttcttagcaacagttgtctgctctttagggtggaagcgatagagaatcctgcttcgtgcatcagcaaatcctccttccttgctatgggaagggcttatgttctaaagggtgattcagtgtcaggcttatgagactgagagtaaagttgatgaggaagaggaggctcagaagtatctgaacaactactctatatgtttatatttttctgcttgaggggatagagatccctcctccatctgcatctgcatatagaactgcttaagaggacagcaagacaagttgctgcagggggatggagggtagacagaatgcctttttttaaaactgaaaattttattgagatacttaatccacctgcacttgtaagaaatcatacagagaaattctattttcctttacacagtttccctgaatgctaacatctagcaaaactgtagtacactgccacaaccaggataactgacattgatataatctactgatcttgttcagatttccttccccagttttgcttatgttcatttctctctgtgtgtgcacgtgtgtgtgttatctatttctatacagctttatcatgtgtaggtttgtgtatctgccactgcagtcaacatacagaacaggccgggcgcagtggctcacgcctgtaatcccagcactttgggaggccaaggcaggtggatcacctgaggtcaggggtttgagagcagcctggccaatatagtgaaacaccgtctctactaaaaataccaaaactagccgggcgtggtggtgcatgcctgtagtcccactactcaggaggctgaggcagcagaataacttgatcccgggaggcggaggttgcagtaagctaagatcctgccacagcattccaggctgagtgacagagcgagactctgtctcaaaaaataaataataatttaaaaaaagatacagaacagttccatcaccacaaggatccctcgcattgctcttttatagcaattttatagcaattttctcctcccacaacccccttccccatctctagctcctggtaacacagatatattctctatttctaaaattttgtcatttgatatatctttttgtaaacatataattatacacacatatttctctaccacttatactttttcaaagtgctttcacatccttatagcaattctgcaaggtagccagggaaggctttcctatttcaggtcagaaaacagatttagaaatattaaatgacttaatgaaggtcacatgtttagcagtagaactagaactgggacccaagtctgatgttcagtcctagaccttttctacttgcccggtctgcctcttcacaagggaagacttgggttttagaatccagagaccttagaaggagcaaattggagaaggtgaggacatgatggcctttactaccggaagcaaaaagtgaatgtccagaggtgaagggacagagaagtaacaggacccatcagcatttcaggcaatttgcttcctttaccaggagggtctctgtcctcttacaacctgggaaaaaataagttgtgtcccaggttgtaagtttgctttacttaggcccaaaggaactaaagaatggatatcagaaatctcaccccaattgttttgtcttacaggcacagaataggttctagcctcagcattttcattaatgtagtgtttttattaacatctccattaacttgcttgcagcaatgagatggaattatgcctcccacaaggcctggggcaagatacttgcataggtgcccccttttgtttggacagtagaaacactgcctcccctgccatggtgttcaatccagttggcaggtgggccagcttcaaagtgcagaaggaactgggtgtggtggctcacccctgtaatcccagcactttgggaggcaggcggatcgcttgaactcaggagtttgagaccactctgggcaacacagtgaaaccctgtctctccaaaaatacaaaaaattagctgggcatggtggctgttgtctgtaatcccaacactttgggaggctgaggccagtggatctcttgagctaaggaggttaagaccagcctggtcaacatggcgaactccgtctctacaaaaaaatacgaaaattagctgggcgtagtagttcctgcctgtagtcctagctacttggaaggctgaggtggggaggatcgcttgagtccgggaggcagaggttgcagtgagcgaagatgatgccattgcactccagtctgggtgacagagcaagatcctgtctcacaaaaaaaaaaaaaaaaaaaaatgcagaaggtccagggcctggccaaggggatgatgccctgtagcactttgctttgcaggaagggaacaactgtgctgtgaataccaggatccaggagggagggagggtatatctgtgtcccccagctagggacaaggcttccttaaccttaggtcctcatgcttatattagttcttctccaacaaagtttgactttgagaagaagctggcacatggctgaaatgcactcacgcggttgggggaagagtgttcttccagtcctcctccccacagggcctcctgcttctcctaagtacctgtcatcaaaggagatgaagatgaatcccccttcagcccccacacctcaatgagttgtcaagtactctccctcccacttgaataggaagcaggagcagcaggccaggttgcaggttgaggaagtcagaagttaacttgagctgagtttgcagctctggagagattgaggagcagacttttctcttgtcactttggaaggagaggattgtgaggctgcccctttaaatagcattcccgtaggaggcagatcacatccatccgtcacctactgccaaagcatcatttttggtttctatcaaactcaaagcttgttggaaaggattgtggggttaggggagtgaggaggcagagcctcctaggggtagggggcagtttagaagctgaaaaggagaggaatgagaaggagcctgggaaaggtgggggatgaggacaagaggaaaagacagggagagaatagttgtcttttgagcctcagagtggaacaagtatacccaattcttatctgtttagagacgcagcaaggtagaaatgggattgtattgcaacaagaggaatgaggttgagactaaacaccaggactggtgactaaagaaagtgaaaggagccacagagtgaaaaaggctgatagacttggctctggttttatcacttactctctgtgagaccctataatttttctgggttagtttagttctcatttatttttatttttactttttccatcaaactgtgttgtctatgaagttttcccatttattaaatgaagggaattagagtggatgaactctaatgtctctttcacgaataactttgtgtgtgtgtgcgtgtgtgtgtgtgtgtgtgtgtgtgtgtgtgaattagccttaaaatgaatcaggagcagggggtcttgggagagcaggatgtgacactgtgttaacaagaaatgttgagagagccctctggatgtatgtcttgcctctttcccacctattctagtttaaagacctgcctaaatttggaaactccttagctctaatcctaatttactaattagagctctttagcaccatcctaatttgcaattcttttgtagtttccagcccatttcattttcagttgataaggaggagattgctcccaaattttcagaaatggactgtgtaggagtgtgactagggtctcagatgcagccatttcttggctgggtctggggaaaagccaagggatgtgtgctaaaggtagatggacagagggtgggaagtcccttattatttccacttttttctccatctctgactctgccatctctttctgcctctgtactttctgggagctggttctgctgatacttctgctgaatctaaatgctgacctaacttggcaattcttttatgttaggagtcttagctgtgacagttcatccgcttcttcgcccttccatttcacttcttttctccttctctgactgggagaggaggagcctccactcagtatttagaacagagtaaataccttctcctgatcactcctccttccaacctccagaattttttgaaattaaaattcacattctggga

SEQ ID NO: 157985 - DNA, 3612 bp, Homo sapiens
  Payload ID: 10946
  Gene Symbol: NCKAP1L
  Gene Name: NCK-associated protein 1-like
  Uniprot ID: P55160
  ENST ID: ENST00000545638
  CDS Start-End: 101-3334
gtgctggggccaagcaggcattaaactctacccatcaagacaaaatgcctagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtgggaatggggtggggtcactaaggagagagggtcaggagccagagttgatgagcagatctgtggaagaacaatccagggctgagaaatcgtagagcagtgaggcaggctgggagcatggaggacagcttatggaaaaagttagggcgtggggccacatgtgtgaattttacaatgaaaaaaggagtaacgtac

SEQ ID NO: 157986 - DNA, 3559 bp, Homo sapiens
  Payload ID: 10946
  Gene Symbol: NCKAP1L
  Gene Name: NCK-associated protein 1-like
  ENST ID: ENST00000548221
  CDS Start-End: 33-1382
tgctgtctggtgctcctctctcagtggccatcatgtctttgacatctgcttaccagcataaattagcagagaagctcactatcctgaatgatcgcggtcagggggttctcatccgtatgtataacatcaagaagacttgttcagaccccaaatctaagccacctttcttactggaaaagtccatggaaccatctctcaagtatatcaacaagaaatttcccaacatagatgtccgaaacagcacgcaacatttaggaccagtacatcgtgaaaaagccgagataattagattcctcaccaactactaccagtcatttgtggatgtcatggaatttcgggatcatgtatatgaacttctcaacaccattgatgcctgccagtgccattttgatatcaatctcaactttgatttcactcggagttacctggacttgattgtaacttacacctcagtcattttacttctgtcacggattgaagatcggcggatactcattggcatgtacaattgtgcccatgagatgctgcatgggcatggtgaccccagttttgcccgtctgggtcagatggtcttggagtatgaccaccctctgaagaagctgacagaagagtttgggcctcacacaaaggctgtgagtggagccctcctctctttgcatttcctctttgtccgaagaaaccagggggctgagcagtggcgcagtgcccaacttctaagcctcatcagcaaccccccagccatgattaaccctgctaattcagatacaatggcctgtgagtatctgtctgtggaagtaatggagcgctggattatcattgggtttcttctttgtcatgggtgcctcaactccaatagccagtgccagaagctgtggaagctgtgtctgcagggctccctctacatcacccttatccgtgaggatgtgctgcaggtgcacaaagtcaccgaggacctgtttagcagtttgaaagggtatggcaagagagtggcagacataaaggagagcaaggaacatgtaattgcaaacagtggccagtttcattgtcaacggcggcaatttctgcggatggcagtgaaggagctggagactgtgttggctgatgaaccgggactactgggtcctaaggctctttttgctttcatggccctgtccttcattcgtgatgaggtcacctggctggttcgccacacagagaatgtcaccaagacaaagacacctgaggactatgctgactcgagcattgcagagctacttttcttgttggaggggattaggtctctggtccgaagacacatcaaagtgatacagcaataccaccttcagtacttggcaagatttgatgctcttgtgctcagtgacatcattcagtttctgtcctagggaacctgtgcccacttgacagtaactgcagctccttttttagaacttgtctgtgtgtccagaggaggagtccatcatcatgtcctcattcgtcagtatcctctcctctctgaatctcaaacaagttgataatggagaaaaatttgaattctcaggattgaggctggactggttccgcctacaggcatacactagcgtggctaaggcccctctgcacctgcatgagaaccctgacttagccaaggtgatgaacctcattgtcttccactcccgaatgctggactccgtagaaaaattgctggtggaaacttctgatctgtctactttctgctttcatcttcgtatctttgagaagatgtttgccatgaccttggaggaatctgccatgttgcgttatgccattgctttccccctgatttgtgctcactttgtccactgcactcatgagatgtgcccagaggagtacccccacctcaagaaccatggtcttcaccactgcaactccttcctggaagagttggccaagcagaccagcaattgcgtcctggagatctgtgctgagcagcgaaacctgagcgagcagcttctacctaagcactgtgccactacaatcagcaaagccaagaacaagaaaaccaggaagcagaggcagactcccagaaaaggagagcccgagagggacaagccaggagctgagagtcaccggaagaaccgcagcattgtcaccaacatggacaagctacacctaaacttgacagaactggcactgacaatgaatcatgtatacagtttctccgtgtttgaacatactatcttcccttctgagtacctcagcagccacctggaggccagactcaacagagccattgtgtggctggctggctacaatgccacgacccaggagatcgtacggccttctgagctgttggcaggagtcaaagcatacattggtttcatacagtcactggcccagtttttgggtgcagatgcttccagagtcatccgcaacgccctcctgcagcagacacaaccactggattcctgtggggaacagacaatcaccacactctacacaaactggtacctggaaagtctgcttagacaggcaagcagtgggaccatcatcctctccccagccatgcaggccttcgtcagcctgcccagagaaggggagcagaacttcagtgcagaggagttctctgacatctctgagatgcgggccttggcagaactcctgggcccctatggcatgaagttcctgagtgaaaacctgatgtggcatgtgacctctcagattgtggagctgaagaagctggtggtggaaaacatggacatacttgttcagatcagatccaactttagcaagccggacttgatggcttccctgctgccccagctgacaggggctgaaaatgtgctaaagcgcatgaccatcattggggttatcctcagtttcagggccatggcccaagagggacttcgggaggttttctcctcccactgcccatttcttatgggtcccattgagtgcttgaaggagtttgtcactccagacacagacatcaaggtgaccttgagtatctttgagctggcatctgctgcaggtgtgggctgtgacattgacccagccttggtggctgccattgctaatctgaaagctgatacttcatctcctgaggaggaatataaggtggcctgcctgctcttgatctttctggcagtttccctcccactccttgccactgacccttcttccttttatagcattgagaaggatggttacaacaacaatattcattgcttgaccaaagccatcatccaggtgtctgctgccctcttcacgctctacaacaagaacattgaaactcacctcaaggaatttctggtggtggcctctgtcagcctcttgcagctgggccaggagactgacaagcttaaaaccagaaatcgagaatccatttctctgctcatgcgcttggtggtggaggagtcatccttcctgaccctggacatgctggagtcctgtttcccttatgtcctgcttcgaaatgcctatcgggaggtgtctcgggccttccacctaaactgaatgcctgccagtacccactgaagagccctttggaccttcctaaacccttgccatagtggaagctgtggtcactttcgcagggggtggg

SEQ ID NO: 157987 - DNA, 388 bp, Homo sapiens
  Payload ID: 10947
  Gene Symbol: NCKAP5
  Gene Name: NCK-associated protein 5
  ENST ID: ENST00000358991
  CDS Start-End: 182-388
caggctttgcagagtttagagcatattctacccaactggccccagatggaaaatactgtcttgaaattggatggctttttaagtgtagctctccacagcctgctcaaagaaaaaaaaaaatgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatg

SEQ ID NO: 157988 - DNA, 7593 bp, Homo sapiens
  Payload ID: 10947
  Gene Symbol: NCKAP5
  Gene Name: NCK-associated protein 5
  ENST ID: ENST00000317721
  CDS Start-End: 375-6104
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatgcatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaaggcaatcatcacaaaactgggataaaaggctaagtattgattcttcgctcccaagtggctttgctagtcctacaaatgaactacctccaactcgtatcaaggaaagccacattttggaagggctaagaaagctacagaagcgaaaagtgttacttgaacccccatcagtgataaccaaatggggttataaagattgcatgaactcgaatgaaggaatatattctcctggaattaaaagtagcagcctcaaggagtatcccccctgcaaaacagctgacctggggagcccctgcaaggaaccccacaagacatttgtttatgatctagattcccacgttgatgcggacgatgacccttccaccttagcattgctccaagcagttccaaaccagagctgcaggccacatggcagtaaattaacccacagtgtttccgacagtctgtttggctgggagacaaacagaaaacactttctggaaggcacatcctcagtttatcccaaggaaaggcctgaaaagctgacaagttgcgccagcagctgtcccttagagatgaagctgtgcccaagtgtgcagacgcctcaggtacagagggagaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggcccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggaggcaggggtgaaatccccttcccctccgccccctccaggcaggtccgtctccctgctggccaggcccagctatgactattcaccagcaccttcatccaccaagtccgaaaccagggtccccagtgaaacagcaaggaccccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagccttccttcttaggggtaaatgagtcaccatcatctcaggtcagcagttcctcatcatcctcatcacccgccaaaagccataacagccctcatggttgtcaaagtgctcatgagaaaggactgaaaactcgccttccagtgggactcaaagtgctcatgaagtctccccagctgctcaggaaaagttccaccgtgccagggaaacatgaaaaagacagtttaaatgaagcctccaaaagttccgtggctgtgaacaagtctaagccagaggactccaagaatccagcaagcatggagatcacagcgggtgaaagaaatgtgaccctaccggattcacaagcacagggcagtttagctgatgggcttcccctggaaacagcactacaagagccattggaaagtagcatccctgggagtgatggaagggatggggtagataatagatccatgagaagatccctttcctccagcaaaccacacctaaaaccagctctgggtatgaatggcgccaaagcccgcagccacagcttcagtacacactcaggagacaagccttctacgccccccatcgaagggtcaggcaaagtccgcactcagatcattaccaataccgccgagagaggcaattctcttacccggcagaactcttccacggaaagctctcccaacaaggccccttctgctcccatgttggagagtctccccagtgttgggaggccctcggggcacccctcctccgggaagggctccctggggagctcaggcagcttcagcagtcagcatgggagcccaagtaagttgcctttgaggatccctccaaagtctgagggactcctcatcccacctggaaaggaagaccagcaggccttcacccagggagagtgccccagtgccaatgtggctgtacttggggaaccaggcagtgaccgccgcagttgcccacccaccccaacagactgccctgaagccctgcagagcccagggaggactcagcatccaagcacttttgaaacaagcagtacatccaagctagaaacttctggaaggcatccagatgcctctgcaaccgcgactgatgctgtgagttcagaagcccccctctcacccacaatcgaagaaaaggtcatgttgtgcattcaggaaaatgtggaaaagggccaagtgcaaacaaagcccacctctgtggaagcaaagcagaagcctgggccttcttttgccagctggtttggttttcggaagagtagacttccagctctgagtagcaggaaaatggacatctccaaaaccaaagtagaaaagaaagatgcaaaagtcttggggtttggaaacagacaactaaaatcagaaagaaaaaaagagaaaaagaagcctgaactacagtgtgagacagaaaatgagcttatcaaggacaccaagtcagcagataatccagatggcggtttacaaagcaaaaataatcggagaacaccacaagacatttacaaccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgc

SEQ ID NO: 157989 - DNA, 3636 bp, Homo sapiens
  Payload ID: 10947
  Gene Symbol: NCKAP5
  Gene Name: NCK-associated protein 5
  ENST ID: ENST00000405974
  CDS Start-End: 375-2147
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatgcatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaagggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgc

SEQ ID NO: 157990 - DNA, 2390 bp, Homo sapiens
  Payload ID: 10947
  Gene Symbol: NCKAP5
  Gene Name: NCK-associated protein 5
  Uniprot ID: O14513
  ENST ID: ENST00000409213
  CDS Start-End: 378-2150
gaagcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaagggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgc

SEQ ID NO: 157991 - DNA, 7594 bp, Homo sapiens
  Payload ID: 10947
  Gene Symbol: NCKAP5
  Gene Name: NCK-associated protein 5
  Uniprot ID: O14513
  ENST ID: ENST00000409261
  CDS Start-End: 375-6104
gcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaaggcaatcatcacaaaactgggataaaaggctaagtattgattcttcgctcccaagtggctttgctagtcctacaaatgaactacctccaactcgtatcaaggaaagccacattttggaagggctaagaaagctacagaagcgaaaagtgttacttgaacccccatcagtgataaccaaatggggttataaagattgcatgaactcgaatgaaggaatatattctcctggaattaaaagtagcagcctcaaggagtatcccccctgcaaaacagctgacctggggagcccctgcaaggaaccccacaagacatttgtttatgatctagattcccacgttgatgcggacgatgacccttccaccttagcattgctccaagcagttccaaaccagagctgcaggccacatggcagtaaattaacccacagtgtttccgacagtctgtttggctgggagacaaacagaaaacactttctggaaggcacatcctcagtttatcccaaggaaaggcctgaaaagctgacaagttgcgccagcagctgtcccttagagatgaagctgtgcccaagtgtgcagacgcctcaggtacagagggagaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggcccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggaggcaggggtgaaatccccttcccctccgccccctccaggcaggtccgtctccctgctggccaggcccagctatgactattcaccagcaccttcatccaccaagtccgaaaccagggtccccagtgaaacagcaaggaccccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagccttccttcttaggggtaaatgagtcaccatcatctcaggtcagcagttcctcatcatcctcatcacccgccaaaagccataacagccctcatggttgtcaaagtgctcatgagaaaggactgaaaactcgccttccagtgggactcaaagtgctcatgaagtctccccagctgctcaggaaaagttccaccgtgccagggaaacatgaaaaagacagtttaaatgaagcctccaaaagttccgtggctgtgaacaagtctaagccagaggactccaagaatccagcaagcatggagatcacagcgggtgaaagaaatgtgaccctaccggattcacaagcacagggcagtttagctgatgggcttcccctggaaacagcactacaagagccattggaaagtagcatccctgggagtgatggaagggatggggtagataatagatccatgagaagatccctttcctccagcaaaccacacctaaaaccagctctgggtatgaatggcgccaaagcccgcagccacagcttcagtacacactcaggagacaagccttctacgccccccatcgaagggtcaggcaaagtccgcactcagatcattaccaataccgccgagagaggcaattctcttacccggcagaactcttccacggaaagctctcccaacaaggccccttctgctcccatgttggagagtctccccagtgttgggaggccctcggggcacccctcctccgggaagggctccctggggagctcaggcagcttcagcagtcagcatgggagcccaagtaagttgcctttgaggatccctccaaagtctgagggactcctcatcccacctggaaaggaagaccagcaggccttcacccagggagagtgccccagtgccaatgtggctgtacttggggaaccaggcagtgaccgccgcagttgcccacccaccccaacagactgccctgaagccctgcagagcccagggaggactcagcatccaagcacttttgaaacaagcagtacatccaagctagaaacttctggaaggcatccagatgcctctgcaaccgcgactgatgctgtgagttcagaagcccccctctcacccacaatcgaagaaaaggtcatgttgtgcattcaggaaaatgtggaaaagggccaagtgcaaacaaagcccacctctgtggaagcaaagcagaagcctgggccttcttttgccagctggtttggttttcggaagagtagacttccagctctgagtagcaggaaaatggacatctccaaaaccaaagtagaaaagaaagatgcaaaagtcttggggtttggaaacagacaactaaaatcagaaagaaaaaaagagaaaaagaagcctgaactacagtgtgagacagaaaatgagcttatcaaggacaccaagtcagcagataatccagatggcggtttacaaagcaaaaataatcggagaacaccacaagacatttacaaccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgca

SEQ ID NO: 157992 - DNA, 2158 bp, Homo sapiens
  Payload ID: 10947
  Gene Symbol: NCKAP5
  Gene Name: NCK-associated protein 5
  ENST ID: ENST00000427594
  CDS Start-End: 1-344
gacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccagaaggaggaaaatgtaacaagatgagaaaagctgtcaattgacctttggacaagcatcagcacagagctcttctcctcttctgcacttgttcccatgtctgactgttcgtcaactttgacctgtctcagaggctggctctcctgagtgccttgctcctcctgatgaatacagagggcaattttctgttgatttggaattgctatttccacatcatcagcaatatttctgcctgagacttttcataaaaattggggcctctcatctgctgctctgtgtgaatctaccagaagttgaagatggtaaagcaacattggttcaaggataaattttcttcaaattacaacagatggaagaaaagattttaaatgacctcttttaaaatgcctggataacataatatggatcatattttggtgtcagaagtttgtatcttagtgatctagcatgtaagctctcccttaagcaatgcaaaggaaagccaaaaccaattatgtagcaaactggaaagaaaggctgttttcggctccttgggcaaatactaacttactgaaagctgaacattactttattgttttgtatttctctttctgcctaataaatgatgaaatggtcacatgtttcttcttaaatttttttaaagaggtatatgtttttgagtagacaacgtgaaagtcatgttgcctattattcatccctgtagagaaaacagtattaacacagagtatagttccaatttcattgcaaagagcactatcttatttaatgggttgtccaggacctggtgtcagtgtacctctaagtagcttaataactctggttaagtaatttgacccttttgggtctcaatttgctcatctgtaacatgagtaaattcaattgcattatagttttataatgctttttatgctttttaaaaggccctgcattagaaatgaaatgtacttacttattgggtgaagtaataatttcacatttgtaaccaggccttcttgaagattctaacaatgagttttatgttgaggtcttggaggagactgtcttattgtccatgctgtaatcacagggaggctctgtgggactgggttttggccatgtctattttggttacttgactctggagaagttgagattagaaaactgccgagcctagatgaaaaatttctgttgggaacagccaaaattaaatactggggaacttggctggcaaaaggaagttaagatactctgctgtgaacatataaccaagattgctcttggctctgatgttgtccactttaggatttatttgaactggtttggtaaaaagtctaaacagagataactttatgacaaccagaattgttttcactttttaacaatttctctgaagaaagagccatcaataaaaataccaatgatttagtctctcctctaaatatgttttaataacatattataacttctgatacattactgttcctactccaacacattttttcctttaagaaaatgtgtgagatacagaataatgttttaaaactgaaaactgaattgatttctactttcaataataaatgttttattttttggtgtggtttatagaaaatccacttttcttacgtttatagtttagataagtttggacaatcattgaccctcatgtaactaccaccacaattaaaatacagaatattttcatgtcctggaccagttctctccctccctctttgttctcatttccctcccaagcccctggtaactactagtcttatttctctccttatagttttgccttttccagaaaggcttataaatgacgaagtcataaagtatggaactttttggtctggc

SEQ ID NO: 157993 - DNA, 4900 bp, Homo sapiens
  Payload ID: 10948
  Gene Symbol: NCKAP5L
  Gene Name: NCK-associated protein 5-like
  Uniprot ID: Q9HCH0
  ENST ID: ENST00000335999
  CDS Start-End: 203-4207
ggaggcggctccggcacccccctttctctgccccccgcccccaagccgcggccatggacctggcggatccggcctgccctggcccagctcaacacctgatttcggcaaggtgaccgttctggatgctagagtgagtgtgcccacctgcgtaagggggcagagacagcctgccggggcttctcttccttgttcccagggccagatgtcagaggccatggaccagccagctgggggtcctggaaacccaaggccaggagagggtgatgatggcagcatggagccaggcacctgccaggagcttctgcaccgactgcgggagctggaggcagagaactcggcacttgcccaggccaacgaaaaccagcgggagacttatgagcgctgtctggacgaggttgccaaccatgtggtacaggcgttgctgaaccagaaggacctgcgagaggagtgcatcaagctgaagaagagagtgtttgacctggaacggcagaaccagatgctgagtgccctgtttcagcagaaactccagctcacgacaggctcgctccctcagatcccactcactccactccagccaccatcagagccaccagcctccccctccctgagctccactgagggaccggctgccccgctgcctctggggcactgtgctgggcagagagaggtatgttgggagcagcagctgaggccaggaggcccaggccccccagccgccccacccccagcgctggatgccctatccccgttccttcggaagaaggcccagattctggaggtgctgagagccctggaagagactgaccccttgcttctctgctcacctgccaccccctggcggcctccaggccaggggcctggctccccagagcccatcaacggcgagctgtgtggcccgcctcagcctgaaccctcaccctgggcgccctgcctgctgctaggccctggcaacctgggaggcctgctgcactgggagcgcctcttggggggtctgggaggggaagaggacactgggcggccctggggtcctagcaggggacctcctcaggcccagggcaccagctctggcccaaactgtgccccaggcagcagctcctcctcctcttctgatgaggcaggtgaccccaatgaggcacccagccccgacaccctgctcggtgccctggcccgcagacagttgaacctgggccagctccttgaggacacagagtcttacctacaggccttcctggccggggctgcaggcccactcaatggggaccacccaggtcctgggcagtcatcctccccagaccaggcgcccccacagctgtctaagtccaaaggcctccccaagtcagcttggggtgggggtaccccagaggcccacaggccaggcttcggtgctacctcagagggccaggggcccctccccttccttagcatgttcatgggtgctggggatgccccactgggctctcggcctggccacccccattcctcatctcaggtgaaaagcaagctccaaattggccccccttctcctggggaagctcagggaccccttctgccctctccagctaggggtctcaagtttctaaagctgcctccaacctcggagaagagccccagcccaggaggcccgcagctcagtccccagctcccccggaactcgcgaatcccctgtcggaacagtggctcagacggcagcccctccccactgttggcccgaaggggtctgggtggaggagagctgtccccagagggggcgcaaggcctgcccaccagcccttcaccctgctacacaaccccagactccacacagctcagacccccgcagtcagccttgtccaccacgctgtccccaggcccagtggtgtctccctgctatgagaacattctggacctttctcggagcacctttagggggccttccccagagccacctccatccccactgcaggtgcccacctacccacagctaactctggaggtaccacaggcccctgaggtcctcagaagccctggagtaccccccagtccttgcctcccagaatcgtacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacaggccccgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaagtggagctggccaagagccggctggcaggggccctgtgcccccaggtaccccgtacccctgccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacagggtggatggcaaggagctgccatccaagagctggcgggagcccaagcctgagtacggggatttccagccggtgtcttctgaccccaagagcccctggccagcctgtgggccccggaatggcctggtgggccctcttcagggctgcggaaaacctcctggaaagccgagcagcgagccagggaggcgggaagagatgccctcggaggacagcctggccgagccagtgcccacctcacacttcacagcctgtggctccttgactcgaaccttggacagtggcattgggaccttcccacccccagaccatggtagcagtgggacccccagcaagaatcttcctaagaccaagccaccgcggctggatcccccacctggggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggccctgcccgtggaccggaagcgaagccaggagcccagccgcccgtcccctacgccccagggcccacctttcgggggtagccgcacccccagcacttcggacatggccgaggaaggcagagtggccagcgggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggttaatttatgtgttgtttaaaatgcggctgctctgcttcctgcctctgcttctgccgtatccctaataaaatgtggaggccccctccctg

SEQ ID NO: 157994 - DNA, 4235 bp, Homo sapiens
  Payload ID: 10948
  Gene Symbol: NCKAP5L
  Gene Name: NCK-associated protein 5-like
  ENST ID: ENST00000433948
  CDS Start-End: 1-3013
cagctctggcccaaactgtgccccaggcagcagctcctcctcctcttctgatgaggcaggtgaccccaatgaggcacccagccccgacaccctgctcggtgccctggcccgcagacagttgaacctgggccagctccttgaggacacagagtcttacctacaggccttcctggccggggctgcaggcccactcaatggggaccacccaggtcctgggcagtcatcctccccagaccaggcgcccccacagctgtctaagtccaaaggcctccccaagtcagcttggggtgggggtaccccagaggcccacaggccaggcttcggtgctacctcagagggccaggggcccctccccttccttagcatgttcatgggtgctggggatgccccactgggctctcggcctggccacccccattcctcatctcaggtgaaaagcaagctccaaattggccccccttctcctggggaagctcagggaccccttctgccctctccagctaggggtctcaagtttctaaagctgcctccaacctcggagaagagccccagcccaggaggcccgcagctcagtccccagctcccccggaactcgcgaatcccctgtcggaacagtggctcagacggcagcccctccccactgttggcccgaaggggtctgggtggaggagagctgtccccagagggggcgcaaggcctgcccaccagcccttcaccctgctacacaaccccagactccacacagctcagacccccgcagtcagccttgtccaccacgctgtccccaggcccagtggtgtctccctgctatgagaacattctggacctttctcggagcacctttagggggccttccccagagccacctccatccccactgcaggtgcccacctacccacagctaactctggaggtaccacaggcccctgaggtcctcagaagccctggagtaccccccagtccttgcctcccagaatcgtacccctatgggagcccccaagagaagagtttggacaaggcaggctcggagtctccccatcccggccgcaggaccccaggcaactcatccaagaagcccagccaggggtcaggacggcgacctggggatcctggcagcacacctctgcgggacagactggcggccctggggaagctgaagacaggccccgagggggccctgggctcagagaagaatggggtgccagccaggcctggcaccgaaaagacccggggacctgggaagtcaggggagagtgctggagacatggtgccctccatccacaggccactggagcagctagaagccaagggggggatacggggggcagtggccttgggcacaaacagcctgaagcagcaggaacctggacttatgggggatcccggggcccgagtctactcctctcactccatgggggcccgggtggacctggagcctgtctcaccaaggagctgcctcaccaaagtggagctggccaagagccggctggcaggggccctgtgcccccaggtaccccgtacccctgccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccggccacggcctggtggcccagccccagggcccaacacggggctggggcaggtgcagggccagctggctggcatgtaccaaggtgcagacaccttcatgcagcagctgctaaacagggtggatggcaaggagctgccatccaagagctggcgggagcccaagcctgagtacggggatttccagccggtgtcttctgaccccaagagcccctggccagcctgtgggccccggaatggcctggtgggccctcttcagggctgcggaaaacctcctggaaagccgagcagcgagccagggaggcgggaagagatgccctcggaggacagcctggccgagccagtgcccacctcacacttcacagcctgtggctccttgactcgaaccttggacagtggcattgggaccttcccacccccagaccatggtagcagtgggacccccagcaagaatcttcctaagaccaagccaccgcggctggatcccccacctggggtacccccagctcggcccccaccccttaccaaagtcccccgccgcgcccacacactggagcgggaggtgccaggcatagaggagctgctggtgagtgggcggcaccccagcatgccagccttccctgcactgctacccgctgctccgggccaccggggccatgagacctgtcctgatgatccctgtgaagacccaggccccacccctcctgtccagctggccaagaactggaccttccccaatactagggcagccggcagctcctcggaccctctcatgtgcccaccccgacaactggaggggctgcccaggacccccatggtgagaattgcagcagaggaaagggaaaggactcgggagcaggagggagtgatgtggggagaccagtttctccagtaaggtacggcctgtgtgtcgcacagtctcagtgctgcaccctctgggaggaggacccctgggatgccctgtgagcggccctccccactgccctccttgcacttctctcgtggggaaaggtttctgtccctccccagaaccttgtaggactgttctcagttgtacctccagcctgtttcctctgaagtataccccaccttgggccccctctggagcagccccccatcaggtgcacagacgcccctcagagctcagtgcctctgaggctgggccgaaaggtggagaggagcttcctcccgagctgcccctcctttcccaggccctgcccgtggaccggaagcgaagccaggagcccagccgcccgtcccctacgccccagggcccacctttcgggggtagccgcacccccagcacttcggacatggccgaggaaggcagagtggccagcgggggccccccagggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggttaatttatgtgttgtttaaaatgcggctgctctgcttcctgcctctgcttctgccgtatccctaataaaatgtggaggccccctccctg

SEQ ID NO: 157995 - DNA, 5134 bp, Homo sapiens
  Payload ID: 10949
  Gene Symbol: NDC1
  Gene Name: NDC1 transmembrane nucleoporin
  Uniprot ID: Q9BTX1
  ENST ID: ENST00000371429
  CDS Start-End: 600-2624
gcgtacctattgtggagaagaccaccacatcctttggtttcacttttaggtgacttataaagtaatagggagaaatgagggcagatcattttgctagctctaactgaagaattccagtcaatcaatactgtggctgttatcggctttataaaagactactattcccagcatgcctcaaggcacctccaggaagaccttgactcccagcattctgtactttggaactccgagtcccagaatgcaacattcctcctacttcctctcagggggccgtcgagactacagttcccagcatgcagcgccgccacctgcttctggcgccccgctggaccctgcttcgaagggaccgtttggtcgccagagggcggttcctggagttacagccgcgtttgcgggacgtgtctgcgcggcagtcctggcctgttgagcttgtccagacgaagcctcgcagggatgggttggagcctgggccgggcttcgctcaggcagcgtttgaggcagacccagcagggtcctcctggggccttcctgcctttgaactgcggtggcgggcgggcgcacggtctcctgtacgccctagactaggggccgccatctccatggccacggccgtgagccggccctgcgccggcaggtcgcgggacatactgtggcgcgttttgggctggaggatagttgcaagtattgtttggtcagtgctatttctacccatctgcaccacagtatttataattttcagcaggattgatttgtttcatcctatacagtggctgtctgattctttcagtgacctgtatagttcctatgtaatcttttacttcctgctgctgtcagtggtaataataataataagtattttcaatgtggagttctatgcagttgtgccttctattccttgctccagactagctctgatagggaagatcattcatcctcagcaactcatgcactcatttattcatgctgcaatgggaatggtgatggcctggtgtgctgcagtgataacccagggccagtacagctttcttgtggttccctgcactggtactaacagctttggtagccctgctgcgcaaacctgcttaaatgaatatcatctttttttcctactgactggagcatttatgggctatagctatagcctcctgtattttgttaacaacatgaactatcttccatttcccatcatacagcaatacaagttcttgcgttttaggagatctctgctcttattagttaaacacagttgtgtggaatcactgttcctggttagaaatttctgcattttatattattttcttggctatattcccaaagcttggattagcactgctatgaaccttcacatagatgagcaggttcataggccacttgacacagtgagtggcctcttaaatctctcgttactctaccatgtctggctgtgtggtgtctttctcctgacgacttggtatgtctcatggatactcttcaaaatctatgccacagaggctcatgtgtttcctgttcaaccaccatttgcagaagggtcagatgagtgccttccaaaagtgttaaatagcaatcctccccccatcataaagtatttagccttgcaggacctgatgttgctttctcaatattctccttcacgaagacaagaagttttcagcctcagccaaccaggtggacatccccacaattggacagccatttcaagggagtgtttgaatcttttaaatggtatgactcagaaactgattctctatcaagaagctgctgctacgaatgggagagtgtcttcatcttacccagtggaacctaagaaattaaattctccagaagaaactgcttttcagacaccaaaatctagccagatgcctcggccttcagtgccaccattagttaaaacatcactgttttcttcaaaattatctacacctgatgttgtgagcccatttgggaccccatttggctctagtgtaatgaatcggatggctggaatttttgatgtaaacacctgctatgggtcaccgcaaagtcctcagctaataagaagggggccaagattgtggacatcagcttctgatcagcaaatgactgaattttctaatccttctccatctacctctattagtgctgagggtaagacaatgagacaacccagtgtgatttattcatggattcagaataaacgtgaacagattaagaatttcttgtcaaaacgggtgctgataatgtattttttcagtaagcacccagaggcctccattcaggctgttttttcagatgcccaaatgcatatttgggcattagaaggtctgtcgcacttagtagcagcatcatttacagaggatagatttggagttgtccagacgacactaccagctatccttaatactttgttgacactgcaagaggcagtcgacaagtactttaagcttcctcatgcttccagtaaaccaccccggatttcaggaagccttgtggacacttcatataaaacattaagatttgcattcagagcatcactgaaaactgccatctatcgaataactactacatttggtgaacatctgaatgctgtgcaagcatctgcagaacatcagaaaagacttcaacagttcttggagttcaaagaatagttaagtaatataaactgtgttcattacactgctgatacaactacagatgggacagtaaatgttcagcattcttggatcagaagaaaacggactaattagatgcttcctttgtcgtggtggttgctttgaaaactatactttaatgggagaaatcatggaaagaaattctcaacagaataactgaaaactgccttttctgtaccgattgctttttgtgtgtgtggtataataaaatctttattcaattttacagaagcattgatggcagtcgaaatgtctctagctcatataacttaatagtaataactaaaaaacttttagaatttacttttgaaaggagggaagccagttctgaaatgagtataggttgatttcatagtcttcttaattaagagtttagctctttgtaaactcaaaatacataaactttttaagtgtagtttcatttactgaaggataaaaatggtaacagtgcagcaatattcacaaaaaatattgtctaacggacatattttgttaatctgttaggttgggtttttgtttccagggacaaattaaatttgtatgattacccaaaaaagggtctcagtttacagatgctaactctatataaaggaatgtggaaaaactcagttcttaagttacaagattaaaaattcacatttggtctttaagaaacaattgactgacatctatgaatttattttgtatcatgctagtaaacacgaagtattaatgtatgggtattttcccagctagttttgctttctttttctggagcaaaacattaagtgattgcagagtttttcaagcaagagaaaaaggtttgcaaaaaaacccaggaaatgttcccttttttccccaccattcatcttcattagatcaaattctgtgaaacttgtctggtctctcaaagggagcagcctctgtagtgttaaatggctaattaaaataggaagatctttatagccagaaacaacttagtcatcaaatagcaagtgaaaccaaaacgtcagagggattactgtacttggaagtatgttgtgtgtcccaaatgtgaacgaagtattgttagaatttattagatcagcttctttggagatcaaagattggaaatcctagtcatagatattcactggactggctttggactgaaatgctcctttgtaattcttttcctattgtcttttccttctagtgtcccaaaatattttctttaaagtcagcacagtactgtatatgaatctttaatgtggtatcatatatgtctacttttgtctgattcatcgatgtattatatctttataattgaatattttagctccgggtcctgttgccccttcaagcagtacatgccaaattataaataggtgctactggccttgagcatatcactgtgggacagttccccaattgtcaagtgtttagatatgtagactattgccatttgtttttttgttttggttttgctttgtgtctgaagctgaattgatttcttttttttgaatgtgaaagttgaatttcaaacgtagtcatttcttacagatggccaagacagaaaattgtggctaggttgactgagaactgttgtcttccatgtattaacacaattaagctttttatattccactctctgtgctgaccctggctgaggcattttgggagacaaggactctgaatcttctgcttccattaaagaagaactgtgatattcaacattggatttctgagaataaagataggatgattcctttgaactttgacttacttgtataaaatgtccagctaggttaggtttttgccatttcctatatactttgggtaaagctacatttgatgagcaatgtgaatgtttctgagaatgttcattcctgttttctcttaagagaatgtgctgtgtactaaatacaggccacatagtgtctgcctgttgaagatctggaaactgcctccccagatctgtattgtatttggtaggtaagggggtcagtttctttttctcattgtgtgttgataatctacacaccatctgttggaaccagggtgttattatggggaactcctcctgtgtactaggaggaggaccttagggagaccaagaggagagaagcatttcctttgatgaagtcacatcctgtctatgagcccactaatgctgtaacattggcctgaaagagagtgttctttaaaagcctttctcggctgttagtataaaaacatgatggtatcagctcttagcatgtttgcttgacccttatggaaggtataaatccacagaacttccttcccagagaactgggaaattgtcctagaaataaaccttgtacagttgagtggacatggataagcaacaatttgttactttgcaggatttgttccttggtaattgtttggtgtgtcatcctgtaaatattcatgatagtctgtttatatccttttgtatatcgttgatactggattgggtagaaaaataaattggcaatttaaaaaaatggaacagttaattgaaa

SEQ ID NO: 157996 - DNA, 2172 bp, Homo sapiens
  Payload ID: 10950
  Gene Symbol: NDC80
  Gene Name: NDC80 kinetochore complex component
  Uniprot ID: O14777
  ENST ID: ENST00000261597
  CDS Start-End: 183-2111
actgcgcgcgtcgtgcgtaatgacgtcagcgccggcggagaatttcaaattcgaacggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagaactagtggacatggatcccggaatagtcaacttggtatattttccagttctgagaaaatcaaggacccgagaccacttaatgacaaagcattcattcagcagtgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagatacatactgccatgaaagaaagctcacctttatttgatgatgggcagccttggggagaagaaactgaagatggaattatgcataataagttgtttttggactacaccataaaatgctatgagagttttatgagtggtgccgacagctttgatgagatgaatgcagagctgcagtcaaaactgaaggatttatttaatgtggatgcttttaagctggaatcattagaagcaaaaaacagagcattgaatgaacagattgcaagattggaacaagaaagagaaaaagaaccgaatcgtctagagtcgttgagaaaactgaaggcttccttacaaggagatgttcaaaagtatcaggcatacatgagcaatttggagtctcattcagccattcttgaccagaaattaaatggtctcaatgaggaaattgctagagtagaactagaatgtgaaacaataaaacaggagaacactcgactacagaatatcattgacaaccagaagtactcagttgcagacattgagcgaataaatcatgaaagaaatgaattgcagcagactattaataaattaaccaaggacctggaagctgaacaacagaagttgtggaatgaggagttaaaatatgccagaggcaaagaagcgattgaaacacaattagcagagtatcacaaattggctagaaaattaaaacttattcctaaaggtgctgagaattccaaaggttatgactttgaaattaagtttaatcccgaggctggtgccaactgccttgtcaaatacagggctcaagtttatgtacctcttaaggaactcctgaatgaaactgaagaagaaattaataaagccctaaataaaaaaatgggtttggaggatactttagaacaattgaatgcaatgataacagaaagcaagagaagtgtgagaactctgaaagaagaagttcaaaagctggatgatctttaccaacaaaaaattaaggaagcagaggaagaggatgaaaaatgtgccagtgagcttgagtccttggagaaacacaagcacctgctagaaagtactgttaaccaggggctcagtgaagctatgaatgaattagatgctgttcagcgggaataccaactagttgtgcaaaccacgactgaagaaagacgaaaagtgggaaataacttgcaacgtctgttagagatggttgctacacatgttgggtctgtagagaaacatcttgaggagcagattgctaaagttgatagagaatatgaagaatgcatgtcagaagatctctcggaaaatattaaagagattagagataagtatgagaagaaagctactctaattaagtcttctgaagaatgaagataaaatgttgatcatgtatatatatccatagtgaataaaattgtctcagtaaagtgta

SEQ ID NO: 157997 - DNA, 442 bp, Homo sapiens
  Payload ID: 10950
  Gene Symbol: NDC80
  Gene Name: NDC80 kinetochore complex component
  ENST ID: ENST00000574096
  CDS Start-End: 1-99
acgactgaagaaagacgaaaagtgggaaataacttgcaacgtctgttagagatggttgctacacatgttgggtctgtagagaggcggatgctggggtgaagcagccgcatgctaaggaacaccaaggactgccaggagccgccagcaactggggagagacgaagaaggattcttccctagagccttcagagagaccatggccctgctgacgtcttgatttcaaacttccggcctccagagctgaaagagtacatttctgttgttttaagccacctagtttgtggcaatttgttacagtatcagtatttgaaatcgcaaaaaaatcaacaaaaacaacaagaaaaaataatgtggcatgttagtttcccattgctaatgtaacaaattaccaccaacctaatggcttaaaacaacacaaatttgtcatcttagagttattaag

SEQ ID NO: 157998 - DNA, 553 bp, Homo sapiens
  Payload ID: 10950
  Gene Symbol: NDC80
  Gene Name: NDC80 kinetochore complex component
  ENST ID: ENST00000575515
  CDS Start-End: 129-553
acggctttggcgggccgaggaaggacctggtgttttgatgaccgctgtcctgtctagcagatacttgcacggtttacagaaattcggtccctgggtcgtgtcaggaaactggaaaaaaggtcataagcatgaagcgcagttcagtttccagcggtggtgctggccgcctctccatgcaggagttaagatcccaggatgtaaataaacaaggcctctatacccctcaaaccaaagagaaaccaacctttggaaagttgagtataaacaaaccgacatctgaaagaaaagtctcgctatttggcaaaagatggagtctcgctctgtcgcccaggctggaatgcagtggcgcgatctcagctcactgcaacctctgcctcgccagttcaagcaattctcctgcctcagcctcccgagtagctgggattacagaactagtggacatggatcccggaatagtcaacttggtatattttccagttctgagaaaatcaaggacccgagaccacttaatgacaaagcattcattcagcagtgtattcgacaactctgtgag

SEQ ID NO: 157999 - DNA, 1075 bp, Homo sapiens
  Payload ID: 10950
  Gene Symbol: NDC80
  Gene Name: NDC80 kinetochore complex component
  ENST ID: ENST00000576274
  CDS Start-End: 1-507
tgtattcgacaactctgtgagtttcttacagaaaatggttatgcacataatgtgtccatgaaatctctacaagctccctctgttaaagacttcctgaagatcttcacatttctttatggcttcctgtgcccctcatacgaacttcctgacacaaagtttgaagaagaggttccaagaatctttaaagaccttgggtatccttttgcactatccaaaagctccatgtacacagtgggggctcctcatacatggcctcacattgtggcagccttagtttggctaatagactgcatcaagagtcttgctttgttgcccaggctggaatgcagtggcatgatctcagctcactacaatctccacctcccaggttcaagcaattctcatgcctcagcctcccaagtagctaggattacaggtgcccaccaccacgcccagctaatttttgtattttcagtagagacagcgtgtcaccatgttggccaggctgatcttgaactcctgacctaaggtgatccacctgcctcagcctcccaaagtgctgggattacaagtgtgagccaccatgcctggccatgtagttttcttaatatcaaacaacatattttttatcaatgccatgtgttttgttactatgatgaacagactctctttttttaattctatttccatggtgattattactaaaagagttttttgtgtttactacccttattgaattgctttattacaactactgttctcagttgatttctattactaaccactgtttttaaattaaatatttttcattgtatcgtttagtatgatatattcagtagaagataatgttttgcatgttgaagtttattcacttttatcaaagaatgatctttgaaggttatcctatgcttttgcaggatgtattgagattattcttgttatcttgacctattgatctaatatgttgatttcctaatgacctctatttgttcattgtttattattcatttgttatgctcctaaattgtttgttcatgctttgtaaataaactttgatttcctatttcactatgcctccttgcacagaacttggcac

SEQ ID NO: 158000 - DNA, 8030 bp, Homo sapiens
  Payload ID: 10951
  Gene Symbol: NDST1
  Gene Name: N-deacetylase/N-sulfotransferase (heparan glucosaminyl) 1
  Uniprot ID: P52848
  ENST ID: ENST00000261797
  CDS Start-End: 503-3151
aacagtaatgccatttttcctggccctgggattaggtgcagccgtgttaaggagaggacattcgagagggcgtggcgaagtgaagaggaacctcacgccactgcctggagctccgccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggacgaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaaggggccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttatagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggttctgtttgta

SEQ ID NO: 158001 - DNA, 576 bp, Homo sapiens
  Payload ID: 10951
  Gene Symbol: NDST1
  Gene Name: N-deacetylase/N-sulfotransferase (heparan glucosaminyl) 1
  ENST ID: ENST00000519157
  CDS Start-End: 100-576
gttaaccctggcccgggccggagcccggaggcgcacgcacggcccgggggacccaggcgtcccgctcctcgccgggagcgccccttcccccgagccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgt

SEQ ID NO: 158002 - DNA, 3449 bp, Homo sapiens
  Payload ID: 10951
  Gene Symbol: NDST1
  Gene Name: N-deacetylase/N-sulfotransferase (heparan glucosaminyl) 1
  ENST ID: ENST00000523767
  CDS Start-End: 590-3067
gattcattctgttctcccggccccgaagggatgacgaggccctgagcaccgatccatgcccacgcctgtggatgaaagctgatatgaggaggcccaggggacctgagggagtcggctccctctgctacctcctgtctcttgagtatcctgtgatcgtgacctgtccattcccaccagtgcaggggtccatgagcccccaaagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggccctgtttgacacacagaacgaactacgcgcacacatcccaaacttcaccttcaacctgggctactcagggaaattcttccacacaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggttctcccacggcagacctgcggcctcttcacacacaccatcttctacaacgagtaccctggcggctccagtgagctggacaagatcatcaacgggggcgagctcttcctcaccgtgctcctcaatcctatcagcatcttcatgacgcacctgtccaactatgggaatgaccgcctgggcctgtacaccttcaagcacctggtgcgcttcctgcactcctggacgaacctccggctgcagacactgccccctgtgcagttggcgcagaagtacttccagatcttctccgaggagaaggacccgctctggcaggacccctgcgaggacaaacgtcacaaagacatctggtccaaggagaagacgtgtgaccgcttcccaaagctcctcatcatcggcccccagaaaacaggcaccactgccctctacctgttcctgggcatgcaccctgacctaagcagcaactaccccagctctgagacctttgaggagatccagttttttaatggccacaactatcacaaaggcatcgactggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccagattctggtcttggatggcaaactgcttcgcacagaacctgccaaagtgatggacatggtgcagaagttccttggggtgaccaacaccattgactaccacaaaaccttggcgtttgatccaaagaaaggattttggtgccaactgcttgaaggaggaaaaaccaagtgtctgggcaaaagcaagggccggaaatatcccgagatggacttggattcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccat

SEQ ID NO: 158003 - DNA, 777 bp, Homo sapiens
  Payload ID: 10951
  Gene Symbol: NDST1
  Gene Name: N-deacetylase/N-sulfotransferase (heparan glucosaminyl) 1
  ENST ID: ENST00000522491
  CDS Start-End: 574-777
gggagaatccgggtggaagtcgagaaatccagccccgatagcagcgctcggtcccgccccggcccccgccccggggcgctcaccgcacgcccgccggccgccccggcctccggagctcttctctggccggcacccacgcggcatcacgggatcgaaccccgctcccagcggccgcgattcggggagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctg

SEQ ID NO: 158004 - DNA, 769 bp, Homo sapiens
  Payload ID: 10951
  Gene Symbol: NDST1
  Gene Name: N-deacetylase/N-sulfotransferase (heparan glucosaminyl) 1
  ENST ID: ENST00000518299
  CDS Start-End: 701-769
gtgatcgtgacctgtccattcccaccagtgcaggggtccatgagcccccaaaggtgcagtgagttgtaggcatttctgtgttttctttttctgaagaaagagtttgttggtttcatcagatcatcagaaggctgggtgtccctgtggagtgctgacggggccgtgtgcactgcgggcttgagaaatggtggcagcgtggtgcaaatagaaagtagcctggtggcagtgtagcatcctgggtcagggtgtggtcttggagacgggctgttggcttctgagctggcacctccacttaggagctgtgtgacattggccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctg

SEQ ID NO: 158005 - DNA, 3535 bp, Homo sapiens
  Payload ID: 10952
  Gene Symbol: NDST2
  Gene Name: N-deacetylase/N-sulfotransferase (heparan glucosaminyl) 2
  Uniprot ID: P52849
  ENST ID: ENST00000299641
  CDS Start-End: 344-2995
aggtagaggggaagagattgaactttgctgacctttgatgtgaggcgctcagccagggccaaggggagagcctggcaagatttgcagcctgaagccatgggccagggggccatggtgacctgagacaagtggactctgtatagttgccccctgcttccccttctacctcccctaccctatgctaaggggactcgtctccacctcgtaaaggaaactccccaagggaatccctgtcccctattttcctatccttctacccttccaagacagtcctagcctatagaactcctacctcccatcccctgaggtggtccccattcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaaggggcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 158006 - DNA, 3749 bp, Homo sapiens
  Payload ID: 10952
  Gene Symbol: NDST2
  Gene Name: N-deacetylase/N-sulfotransferase (heparan glucosaminyl) 2
  Uniprot ID: P52849
  ENST ID: ENST00000309979
  CDS Start-End: 558-3209
gagatggcggagcagccgcgacgcggcccgtggccccgaaagcagggaagccgggcagccccgggacgcggcggagcccggggacagcggggacgccgcccagtcctccgggtatgaagctaaaatgcagcggctaagaacgcggctctggagcttgacaggcctgacgtcgaatcccagccctcccaccaactgagctgtgtgatcctgggcaaggtagaggggaagagattgaactttgctgacctttgatgtgaggcgctcagccagggccaaggggagagcctggcaagatttgcagcctgaagccatgggccagggggccatggtgacctgagacaagtggactctgtatagttgccccctgcttccccttctacctcccctaccctatgctaaggggactcgtctccacctcgtaaaggaaactccccaagggaatccctgtcccctattttcctatccttctacccttccaagacagtcctagcctatagaactcctacctcccatcccctgaggtggtccccattcctccctcccttcctccccccgccatgctccagttgtggaaggtggtacgcccagctcggcagctggaactgcaccgcctcatactgctgctgatcgctttcagcctgggctccatgggcttcctggcttattatgtgtccaccagccctaaggccaaggaacccttgcccctgcccttgggagactgcagcagcggtggggcagctggtcctggccctgcacggcctccagttccacctcggccccccaggcctccagagacagctcgaactgaacccgtggtccttgtgtttgtggagagtgcatactcacagctggggcaggaaattgtggccatcctggagtctagtcgttttcgttatagcactgagttggcacctggccgaggggacatgcccacattgactgataatacccatggccgctatgtcttggtcatttatgagaacctgctcaagtatgtcaacctggatgcctggagtcgggaactgctagaccggtactgcgtggagtatggtgtgggcatcattggctttttccgagcccacgagcacagcctactgagcgcccagctcaagggctttcccctttttttacactcaaacttggggctccgggactaccaagtgaatccttctgccccgctactgcatctcacacgccccagccgcctagaaccagggccactgcctggtgatgactggaccatcttccaatccaatcatagtacatatgaaccagtgcttcttgccagccttcggccagctgagcccgcagtgccaggaccagttcttcgtcgggcccggcttcccactgtggtacaggacctggggcttcatgatggcatccagcgggtgctctttggacatggcctttccttctggctccacaaacttatcttcgttgatgctgttgcatacctcactggcaagcgcctctgcctggaccttgaccgctacatcttggtagacatcgatgacatctttgtgggcaaggaagggacccgcatgaaggtggctgatgttgaggctctgttgaccacccagaacaaactcaggaccttagttcccaacttcaccttcaacttgggcttctcgggcaagttctatcatactgggacagaggaggaggatgcaggggacgacatgctgctgaagcaccgcaaagagttctggtggttcccccacatgtggagccacatgcagccacacctgttccacaatcgctccgtgctggctgaccagatgaggctcaacaaacagtttgctctggagcatgggattcccacggacctggggtatgctgtggccccccaccactcgggtgtgtaccccatccacacgcagctctatgaggcctggaaatccgtgtggggcatccaggtgaccagcactgaggagtatccccatctccgccctgcccgctaccgccgtggcttcattcacaatggcattatggtgctgccccggcagacatgtggcctcttcactcacacaatcttctataatgagtatcctggaggctctcgtgaactagaccggagcatccgaggtggagagctctttctgacagtgctgcttaatccgatcagcatctttatgacccatctgtccaattatggaaatgaccggctgggcctatacacctttgagagcttggtgcgcttcctccagtgttggacacggctgcgcctacagacccttcctcctgtcccacttgcacagaagtactttgaacttttccctcaggagcgaagccccctttggcagaatccctgtgatgacaagaggcacaaagatatctggtccaaggagaaaacctgtgatcgtctcccgaagttcctcattgtgggaccccagaaaacagggactacagctattcacttcttcctgagcctgcacccagctgtaactagcagcttccctagccccagcacatttgaggagattcagttcttcaacagccctaattaccacaagggtattgactggtacatggatttcttccctgttccttccaatgccagcactgatttcctatttgaaaaaagtgccacctactttgactctgaagttgtaccacggcggggggctgccctcctgccacgagccaagatcatcacagtgctcaccaaccctgctgacagggcctactcctggtaccagcatcagcgagcccatggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgagtcccgtcttttccttacggattttttccggaaccataatttggagttgtcgaagctgctgagccggcttggacagccagtgccctcgtggcttcgggaagaactgcagcattccagtctgggctgatgtcccagcctcccataccagcaaaatgccccctgcttccctaaggggcaggtccagagcagggcccacaagggggattagagtggcctggcccctccccctctacctcagtagcccccaggcctgagatggctgagaagggaagggtatccttttcccacagttctgggacaaataaaggggcttcctttggtaccccacataatagtgctaggtacctttgacccatcatcttgggaggtggggaggaatgagagggtccaggcagggtgtaggggaatgtattagtccaatgagatttccctcttcatccgcagcagtgtatctattctatacctggctatgggagagaccccttgcatgggagggaccccttgctatggcccctttagccaggcagtgggatctacctgtggcccggcctccctaatgtcattcacattgaatggggatgaggtcggacagtggctcatagagccgagtatgagccctagctgtgggctagaaatgtccttaataaacatccttatttttctgttt

SEQ ID NO: 158007 - DNA, 447 bp, Homo sapiens
  Payload ID: 10952
  Gene Symbol: NDST2
  Gene Name: N-deacetylase/N-sulfotransferase (heparan glucosaminyl) 2
  ENST ID: ENST00000429742
  CDS Start-End: 1-447
ggagacccagttgctctgaactataccttctatcaggtgatttcagcctcctcccagacccctctggcactacgctccctgcagaaccgctgtcttgtccctggctactattctacccatctacaacgctggctgacttactacccctctggacagttgctgattgtggatgggcaagagctgcgtaccaacccagcagcctcaatggagagcatccagaagttcctgggtatcacaccctttctgaactacacacggaccctcaggtttgatgatgataagggattttggtgccagggacttgaaggtggtaagactcgctgtctaggccggagcaaaggccggaggtatccagatatggacactgaggtaagtaaagccaggggcaggggaatccctctccacttccaggatctgattctgtgtcccacttcttaccatttctgc

SEQ ID NO: 158008 - DNA, 5961 bp, Homo sapiens
  Payload ID: 10953
  Gene Symbol: NDST3
  Gene Name: N-deacetylase/N-sulfotransferase (heparan glucosaminyl) 3
  Uniprot ID: O95803
  ENST ID: ENST00000296499
  CDS Start-End: 404-3025
ccggtcccttggcgacgggtcttgcatgtgacactcttgccctctagtgcctcaccagcttggtagcagtttgatggctaatattaataagatgttacataacatgagagtactgggccaggactggtgttgctaccacttgtaaagtcaaaaagcctgagccgatggtaacgagtggtactgtttccgtttcttttccatctattgcaactttctcaagcattttcagctctgaactttaattccagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggccctgcttgatactcagaatcttttgcgtgcacaaatcacaaattttacattcaacctgggattttcagggaaattttaccatacaggaactgaagaggaagatgaaggagatgactgtctgttggggtctgtggatgagttctggtggtttcctcacatgtggagccatatgcagccccacctcttccacaatgagtcatctttggtggagcagatgattctcaacaaaaaatttgccttagagcacggcattccaacggacatgggctacgctgtggcccctcaccattcgggcgtctaccctgtacatgttcagctttatgaggcctggaagaaggtctggaatattaaaatcaccagcactgaagaatatccacatctgaagccagctagataccggaggggttttatccacaaaaacatcatggttctcccaagacaaacctgtgggcttttcactcacaccattttctacaaagaatatccagggggtcctaaagagctggataagagtatccaaggaggagaacttttcttcactgtcgtcctcaaccctatcagcattttcatgacccatttgtccaactatgggaatgaccgactgggattatatacatttgttaatctggccaactttgtgaagagctggaccaacctgcgacttcagactctgcctccagtacaactggcccacaagtattttgagctgtttcctgatcagaaagaccctctctggcagaatccttgcgatgacaaacgccacagagacatttggtctaaagaaaaaacttgtgatcgcttaccaaaattcttggtaataggaccccagaaaactggtaccactgctttgtatttgttcctggttatgcatccttccatccttagtaactcccccagcccaaaaacctttgaggaggtacagttctttaatagaaataactaccacagggggattgattggtatatggatttcttcccagtcccatctaatgtcactaccgactttttgtttgagaagagtgccaattacttccactcagaggaagcccctaaaagagctgcttctctggttcccaaagccaagattatcaccattctcattgacccttcagaccgagcatactcctggtaccagcatcagcgatcacatgaagaccctgcagctctgaagtttagcttctacgaagtgatctcagcagggccccgtgcaccctcggagctcagagccttgcagaagagatgtttggtcccggggtggtatgccagccacatcgagagatggcttgtttatttccccccatttcagttgctaattattgatgggcaacaactaagaactgatcctgctacagtgatggatgaagtacagaagtttctaggagtcttgcctcattataattactcagaagctttaacgtttgattctcataaaggtttctggtgtcagttactggaagaaggtaaaacaaaatgccttggaaagagcaaaggaagaaaataccctccaatggattctgatagcaggacatttctgtcaagctactatcgagatcacaacgtggaactctcaaagctgctgcacaaactgggtcagcctctgccatcctggctgagacaggagctgcagaaagtaagatagcactgagagaaaacttgagacttcatcgtccatgtagaacacaccttttccaaagcttccagaagctaccaaaaggcagttgaaaaatatacctcttcaaatgagaaaaaagaacagtttcttccatgtgctggcacgtggatgattagaaaaaaagaaaaagtatgtgttacaagccttgaggcctgtggcctttctcttaacccatatctgagcctgtgggattattgtagactactgtgcactcatgtggaagtcaattgcaaccaacataaatatcaaacacaaatgcagaactgttccatttcatagtaatatttacacttttatatatcaactaagattgtgtctctgtaggtttttagaccactgtttgcctgtacgatgttttcttattattttattctataaagtgtcctatgaaacaagaagcaaaataaacatcacaatgtagcataaaatgtcaaaagcataacacccatgaaaaatgcttgccaaaatttaaatccacttaagtatttagaaataattgtaaattataatttgtgctagatcagagtggaaaagttatatatgagtgttatctgcaccaaaaaaaaataagtgctatagcaaaagtgattttttcatatacatagtctagtgaatatatgtaaaaattactaactcttccatcacaacgtaattgttatactgaaatatatactgtaaagctgttggatggtaaatagaaacacatcaagtacaccaaaacagtaaataacaatgtaaagtgtactgactgaatcctctaaaagggagaaattgtaggggtctaaaaacatatcatcgagaattctatgtccacttgctgtaagctgtgaatctatcccagtagtcctcactagttctacagaaatgcatgcctagagtctgaggtatgtgtcatctccagaaacaggttgacttttaaatgtgaatagctatttttaatgctccccaaaacaaaacctattaaactaaaactaaaaacagtttccctagatgatgtggttaggctatttacatttaggttattaaaaaattgcattttcccagatagttcaaaataaaattatgtaatgtagtagagatttataacaaaaaacaaattaatatattatttgtaatctaatgtttgcaatgatacttttgatataaggcaaagaaacataagcagagcagaggcccatttttgaaaatatttcacccatcactctggtggaagtaacagatcataggtacaattaaggattagctactaaattaaatgcaggaagtacaaagatgagcaagtcatgctcttgaaatatatttacatttcaattgtaaataatatatatggttaataaagtttccaaaaaagaaaagaatacatcatacttattttcctgttaatatttacttaatttttttttttgagagggggacagagtctcactatgtcacccaggctggagtgcaatggtgtgatctcagctcactgcaacctccgcctcctgggttcaagtgattctcctgcctcagcctcctgaggagctgggattacagccatgcaccaccacgcccgggtaatttttgtatttttagtagtgacagggtttcaccatgttgactaggctgatcttgaactcctgacctcatgatccacccaccttggcctctcaaagtgctgagattacaagcgtgagccaccatgccctgactacttaatttttaaatgtactgtacatatacataaaatttaagtagtaaattaattccctgctatgattataagcctttataaaatattatcaaaggtatgattagaaacaaatgggaggaaaacccatagtaaaaatattttcattgtcattttaatgggtaaaactatcaattactaattagaaaatgaattgtgagatccacttactataaatttttaactgtacattataattacttttttaaagtttcatgtacctaaagcatatgctaatttttaaatatactattagcagaaaaaattggaaaaatcaccaatttttaagactcttgactctaaaagcaaaatcaaagtgatttggacaaatatgggaaacacagtcttcatgcttactgctgtctcttttatagcagcagatgccagacatgctaggaaaattactatagtcttccatctccaccaacttaagaaaactggcttaggaaggttaaacatgagaataggcctcagcagttatatacagtgtcatgttttcatttggcaacaacatttattctaataaaaaaagaaaagaaaaactgatacatttatgctttaatggtaagatgtacatttgaactgctaagcaaagctgctaatggcctattttgtttaggtaaatcgagttgactgaacacttcatccttttaaatagatgtcaaaaacatactccgtgtttgtataaagacaggagaaaaaggaagagatcttaccaaaatttattcattcacaagtacatgtattacgctagctagagcagcaaacctgtgaaaggatttttgaccactcaatgtgtcttgaagacagcatcaaattctagaggacatgcatactttccacattatatactccaactggttaatatgctaatctgaaagtaacataaatacatatgagagaataatgagagataatctgatttaaaactagctttgtatagaattccctttttcattgtttaaaatatgaaacttcctcaggaagaaatgaaatggttatttcaatgtttatagctgtaatattcttgtcattcacattgaatgaaaattactggaaacatttttttctctgagttttttaaaataaaaaacctagatataattctgatagtagcatggtacctcatatgtacaacaataaactgataggaaaatgaagagtttggacctgg

SEQ ID NO: 158009 - DNA, 3351 bp, Homo sapiens
  Payload ID: 10954
  Gene Symbol: NDST4
  Gene Name: N-deacetylase/N-sulfotransferase (heparan glucosaminyl) 4
  Uniprot ID: Q9H3R1
  ENST ID: ENST00000264363
  CDS Start-End: 680-3298
aaagaccgactacagctaaacaagaggcacagcagcactagcaacagcagagcaggagcagctggtattccggtgattaaatagttctcatagcctttttgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctagattatgcttagaggattctgcagcaattctcagtattggacatattcaaaatctcctcaacgtatatccttcccatctattgccttccagctttaactcagttgtgctcccttcaaacattttacatgatttgcgatggttacatgaactctggggaagtgatatttgcaacatctcatactttattcactatggcactttaggaaacgaaattgggaaaaagcttccaaaacattattctaaaaaatgaatcttattgtgaaacttcggagaagttttcgaacattgattgttctcttagctaccttttgcttggtgagcattgtcatttctgcctattttctctactctggctacaaacaggaaatgacacttattgaaaccactgcagaagcagaatgcactgacatcaaaattctaccatataggtcaatggagctgaaaacagttaaacctattgacacatccaaaacggaccctactgtccttctcttcgtggagagccaatactctcaactcggtcaagatatcatagctattttggagtccagccgatttcagtaccacatggttattgcccctggaaagggagatatacctcctcttacagataatggcaaagggaaatatactttagttatttatgaaaatattctgaagtatgtcagcatggactcatggaatcgagagcttttagaaaaatactgtgtggaatacagtgttagtataatcggttttcataaagccaatgagaacagcttaccaagtacacaattaaaaggctttccgttaaaccttttcaataatctagctctaaaggactgttttgttaaccctcaatctcctttgctgcatattaccaaagcccccaaggttgagaaaggccctcttcctggggaagactggactattttccaatataatcattcaacctaccagcctgtacttttaactgagttacagacagaaaaatccctgtcatccttgtctagcaaaacactctttgcaacggtgattcaggatctggggcttcatgatggaattcagagagtactttttggcaacaacttgaacttttggctgcacaagctcatcttcatagatgccatctccttcttgtcagggaagaggctgacattgtccttggacaggtacatccttgtggacattgatgatatatttgttgggaaagagggaacaaggatgaatgtcaaagatgtgaaggcattactagagactcaaaatttactgcgcactcaggttgcaaattttaccttcaaccttggattttcagggaagttttaccacacagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccaatcagcattttcatgacccatttatcaaactatggaaatgaccgcctagggttatatacctttgtgaacttggtcaactttgtgcagagctggaccaacctgaaattgcaaactctgcctccagtgcaactggcccaccagtattttgagctcttccctgagcagaaagaccctctatggcagaatccatgtgatgataaacgacacaaagacatctggtccagagagaaaacttgtgaccacttaccaaaatttctagtaattggtccacaaaaaacaggaacaactgcactttatttatttcttcttatgcatccttcaatcatcagcaatctccctagtccaaagacatttgaggaagttcagttctttaatggcaacaactatcacaaaggaatagactggtatatggactttttccctacaccatccaatactacaagtgactttctgtttgaaaagagtgctaattacttccattcggaagaagctccaagacgagccgcatctcttgtccccaaagccaagatcatcaccatcctcattgacccctcagacagggcatactcttggtaccagcaccaacgatcacatgaagatccagctgctctgaggttcaatttctatgaagttatttcaacaggacattgggctccatctgacttaaaaactttgcagagaagatgcctagtacctggatggtatgcagtccacatagaaagatggctaacttactttgctacttctcagttgctaattattgatggacagcagctgagatctgacccagctactgtgatggatgaagtccagaagtttctgggagttacacctcgttataattactctgaagcactaacgtttgatccccaaaagggtttttggtgtcaattactggaaggaggaaagacaaaatgccttggaaaaagcaaaggccgaaaatatccacctatggatccagagtctagaacgttcctctctaattactaccgagatcataatgtggaactatccaaactgctacacagactgggacagcctctgccatcgtggctgagacaggaactgcagaaagtgagatagcactggagacaagaactaagcctctcaagatacttttagtgttaaaaaaaaaa

SEQ ID NO: 158010 - DNA, 2015 bp, Homo sapiens
  Payload ID: 10954
  Gene Symbol: NDST4
  Gene Name: N-deacetylase/N-sulfotransferase (heparan glucosaminyl) 4
  Uniprot ID: Q9H3R1
  ENST ID: ENST00000504854
  CDS Start-End: 406-1515
tgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccaatcagcattttcatgacccatttatcaaactatggaaatgaccgcctagggttatatacctttgtgaacttggtcaactttgtgcagagctggaccaacctgaaattgcaaactctgcctccagtgcaactggcccaccagtattttgagctcttccctgagcagaaagaccctctatggcagaatccatgtgatgataaacgacacaaagacatctggtccagagagaaaacttgtgaccacttaccaaaatttctagtaattggtccacaaaaaacaggaacaactgcactttatttatttcttcttatgcatccttcaatcatcagcaatctccctagtccaaagacatttgaggaagttcagttctttaatggcaacaactatcacaaaggaatagactggtatatggactttttccctacaccatccaatactacaagtgactttctgtttgaaaagagtgctaattacttccattcggaagaagctccaagacgagccgcatctcttgtccccaaagccaagatcatcaccatcctcattgacccctcagacagggcatactcttggtaccaggttggagtgcaatggcgtgatctcggctcactgcaaccttcacctcccaggttcatgccattctcctgcctcagcctcctgagtagctgggactacagcaccaacgatcacatgaagatccagctgctctgaggttcaatttctatgaagttatttcaacaggacattgggctccatctgacttaaaaactttgcagagaagatgcctagtacctggatggtatgcagtccacatagaaagatggctaacttactttgctacttctcagttgctaattattgatggacagcagctgagatctgacccagctactgtgatggatgaagtccagaagtttctgggagttacacctcgttataattactctgaagcactaacgtttgatccccaaaagggtttttggtgtcaattactggaaggaggaaagacaaaatgccttggaaaaagcaaaggccgaaaatatccacctatggatccagagtctagaacgttcctctctaattactaccgagatcataatgtggaactatccaaactgctacacagactgggacagcctctgccatcgtggctgagacaggaactgcagaaagtgagatagcactggagacaagaactaagcctctcaaga

SEQ ID NO: 158011 - DNA, 3439 bp, Homo sapiens
  Payload ID: 10954
  Gene Symbol: NDST4
  Gene Name: N-deacetylase/N-sulfotransferase (heparan glucosaminyl) 4
  Uniprot ID: Q9H3R1
  ENST ID: ENST00000613194
  CDS Start-End: 1817-2926
aaagaccgactacagctaaacaagaggcacagcagcactagcaacagcagagcaggagcagctggtattccggtgattaaatagttctcatagcctttttgctgtactcggtctgctccctggtgtaattctcgtgtccaagaaggaagctgcattttaacggtgtgctgaacagaggtttgaatcattccagctggctgcttgttttgaaaaggacaatgtgtgtataaataaaaggactctgctggaagagttcagacactaagactggagctagagagtgctcttggaatattgttgaggcagattgcatgaactgaaagctccttctaattaacctggagccaagtgaacctgaatactggatatctcatgttctaacacgggataaattcaagttagaaaaagacaaaatattgaaatgcttctctagattatgcttagaggattctgcagcaattctcagtattggacatattcaaaatctcctcaacgtatatccttcccatctattgccttccagctttaactcagttgtgctcccttcaaacattttacatgatttgcgatggttacatgaactctggggaagtgatatttgcaacatctcatactttattcactatggcactttaggaaacgaaattgggaaaaagcttccaaaacattattctaaaaaatgaatcttattgtgaaacttcggagaagttttcgaacattgattgttctcttagctaccttttgcttggtgagcattgtcatttctgcctattttctctactctggctacaaacaggaaatgacacttattgaaaccactgcagaagcagaatgcactgacatcaaaattctaccatataggtcaatggagctgaaaacagttaaacctattgacacatccaaaacggaccctactgtccttctcttcgtggagagccaatactctcaactcggtcaagatatcatagctattttggagtccagccgatttcagtaccacatggttattgcccctggaaagggagatatacctcctcttacagataatggcaaagggaaatatactttagttatttatgaaaatattctgaagtatgtcagcatggactcatggaatcgagagcttttagaaaaatactgtgtggaatacagtgttagtataatcggttttcataaagccaatgagaacagcttaccaagtacacaattaaaaggctttccgttaaaccttttcaataatctagctctaaaggactgttttgttaaccctcaatctcctttgctgcatattaccaaagcccccaaggttgagaaaggccctcttcctggggaagactggactattttccaatataatcattcaacctaccagcctgtacttttaactgagttacagacagaaaaatccctgtcatccttgtctagcaaaacactctttgcaacggtgattcaggatctggggcttcatgatggaattcagagagtactttttggcaacaacttgaacttttggctgcacaagctcatcttcatagatgccatctccttcttgtcagggaagaggctgacattgtccttggacaggtacatccttgtggacattgatgatatatttgttgggaaagagggaacaaggatgaatgtcaaagatgtgaaggcattactagagactcaaaatttactgcgcactcaggttgcaaattttaccttcaaccttggattttcagggaagttttaccacacagggactgaagaggaagatgaaggagatgaccttttacttcggtctgtggatgagttctggtggtttcctcacatgtggagccacatgcagccccacctcttccacaacgagtcatctttagtagagcagatgattctcaacaaggaatttgcactggaacatggaataccaatcaacatgggctatgctgtggccccacatcactcaggggtctacccggttcacattcagctgtatgcagcttggaagaaggtctggggtattcaagtcaccagcactgaagaatatccacatctgaaacctgcccggtacagaaagggcttcattcacaatagcatcatggtcctccctcgacagacttgtgggttgttcactcacactattttctacaaagaatatccaggaggaccccaagaactggataaaagtatcagaggaggtgaactttttctcacaatccttctaaacccaatcagcattttcatgacccatttatcaaactatggaaatgaccgcctagggttatatacctttgtgaacttggtcaactttgtgcagagctggaccaacctgaaattgcaaactctgcctccagtgcaactggcccaccagtattttgagctcttccctgagcagaaagaccctctatggcagaatccatgtgatgataaacgacacaaagacatctggtccagagagaaaacttgtgaccacttaccaaaatttctagtaattggtccacaaaaaacaggaacaactgcactttatttatttcttcttatgcatccttcaatcatcagcaatctccctagtccaaagacatttgaggaagttcagttctttaatggcaacaactatcacaaaggaatagactggtatatggactttttccctacaccatccaatactacaagtgactttctgtttgaaaagagtgctaattacttccattcggaagaagctccaagacgagccgcatctcttgtccccaaagccaagatcatcaccatcctcattgacccctcagacagggcatactcttggtaccaggttggagtgcaatggcgtgatctcggctcactgcaaccttcacctcccaggttcatgccattctcctgcctcagcctcctgagtagctgggactacagcaccaacgatcacatgaagatccagctgctctgaggttcaatttctatgaagttatttcaacaggacattgggctccatctgacttaaaaactttgcagagaagatgcctagtacctggatggtatgcagtccacatagaaagatggctaacttactttgctacttctcagttgctaattattgatggacagcagctgagatctgacccagctactgtgatggatgaagtccagaagtttctgggagttacacctcgttataattactctgaagcactaacgtttgatccccaaaagggtttttggtgtcaattactggaaggaggaaagacaaaatgccttggaaaaagcaaaggccgaaaatatccacctatggatccagagtctagaacgttcctctctaattactaccgagatcataatgtggaactatccaaactgctacacagactgggacagcctctgccatcgtggctgagacaggaactgcagaaagtgagatagcactggagacaagaactaagcctctcaagatacttttagtgtt

SEQ ID NO: 158012 - DNA, 1784 bp, Homo sapiens
  Payload ID: 10955
  Gene Symbol: NDRG2
  Gene Name: NDRG family member 2
  Uniprot ID: Q9UN36
  ENST ID: ENST00000298684
  CDS Start-End: 13-999
tgccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctccc

SEQ ID NO: 158013 - DNA, 2122 bp, Homo sapiens
  Payload ID: 10955
  Gene Symbol: NDRG2
  Gene Name: NDRG family member 2
  Uniprot ID: Q9UN36
  ENST ID: ENST00000298687
  CDS Start-End: 174-1289
cggccccccgcattccccgcccccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtta

SEQ ID NO: 158014 - DNA, 2127 bp, Homo sapiens
  Payload ID: 10955
  Gene Symbol: NDRG2
  Gene Name: NDRG family member 2
  Uniprot ID: Q9UN36
  ENST ID: ENST00000350792
  CDS Start-End: 221-1294
atcctctccccaccccccgcctgcccgcgatcgccctctatttatagcggccccccgcattccccgcccccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtta

SEQ ID NO: 158015 - DNA, 2047 bp, Homo sapiens
  Payload ID: 10955
  Gene Symbol: NDRG2
  Gene Name: NDRG family member 2
  Uniprot ID: Q9UN36
  ENST ID: ENST00000360463
  CDS Start-End: 150-1223
tctccccaccccccgcctgcccgcgatcgccctctatttatagcggccccccgcattccccgcccccacctccccgccttgttgtccaacttctcccggagcagccggagagcaggcgtcgggacgcagcaaagagaggagaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 158016 - DNA, 2096 bp, Homo sapiens
  Payload ID: 10955
  Gene Symbol: NDRG2
  Gene Name: NDRG family member 2
  Uniprot ID: Q9UN36
  ENST ID: ENST00000397844
  CDS Start-End: 326-1351
actcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctga

SEQ ID NO: 158017 - DNA, 2084 bp, Homo sapiens
  Payload ID: 10955
  Gene Symbol: NDRG2
  Gene Name: NDRG family member 2
  Uniprot ID: Q9UN36
  ENST ID: ENST00000397847
  CDS Start-End: 179-1261
attgaccccagagtccctgttggccatcctctccccaccccccgcctgcccgcgatcgccctctatttatagcggccccccgcattccccgcccccacctccccgccttgttgtccaacttctcccggagcagccggagagcaggcgtcgggacgcagcaaagagaggagaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 158018 - DNA, 2022 bp, Homo sapiens
  Payload ID: 10955
  Gene Symbol: NDRG2
  Gene Name: NDRG family member 2
  Uniprot ID: Q9UN36
  ENST ID: ENST00000397851
  CDS Start-End: 84-1199
gggtctgcgggaagcccgagccggggcgggcccgagtcaaaggcaagtgaaggtggaagcggccgcggcggcagcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 158019 - DNA, 2079 bp, Homo sapiens
  Payload ID: 10955
  Gene Symbol: NDRG2
  Gene Name: NDRG family member 2
  Uniprot ID: Q9UN36
  ENST ID: ENST00000397853
  CDS Start-End: 140-1255
aagcccgagccggggcgggcccgagtcaaaggcaagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 158020 - DNA, 1309 bp, Homo sapiens
  Payload ID: 10955
  Gene Symbol: NDRG2
  Gene Name: NDRG family member 2
  ENST ID: ENST00000397856
  CDS Start-End: 93-1163
gcggccgcggcggcagcagaccccagagtcagaaggagtgagaaccctgacccctaatcccactgcatccagccaataggagcccagccaccatggcggagtgcaggaggtgcagatcacagaggagaagccactgttgccaggacagacgcctgagggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccc

SEQ ID NO: 158021 - DNA, 2054 bp, Homo sapiens
  Payload ID: 10955
  Gene Symbol: NDRG2
  Gene Name: NDRG family member 2
  Uniprot ID: Q9UN36
  ENST ID: ENST00000397858
  CDS Start-End: 107-1222
cggccccccgcattccccgcccccacctccccgccttgttgtccaacttctcccggagcagccggagagcaggcgtcgggacgcagcaaagagaggagaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgagtaccgtt

SEQ ID NO: 158022 - DNA, 1500 bp, Homo sapiens
  Payload ID: 10955
  Gene Symbol: NDRG2
  Gene Name: NDRG family member 2
  Uniprot ID: Q9UN36
  ENST ID: ENST00000403829
  CDS Start-End: 22-1125
ctcaccgggttggggacagggatggaaaatggtggttccatgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaa

SEQ ID NO: 158023 - DNA, 545 bp, Homo sapiens
  Payload ID: 10955
  Gene Symbol: NDRG2
  Gene Name: NDRG family member 2
  ENST ID: ENST00000449431
  CDS Start-End: 1-545
actcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaa

SEQ ID NO: 158024 - DNA, 1919 bp, Homo sapiens
  Payload ID: 10955
  Gene Symbol: NDRG2
  Gene Name: NDRG family member 2
  ENST ID: ENST00000557353
  CDS Start-End: 40-453
aagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 158025 - DNA, 578 bp, Homo sapiens
  Payload ID: 10955
  Gene Symbol: NDRG2
  Gene Name: NDRG family member 2
  ENST ID: ENST00000554893
  CDS Start-End: 303-578
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttgggaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaa

SEQ ID NO: 158026 - DNA, 639 bp, Homo sapiens
  Payload ID: 10955
  Gene Symbol: NDRG2
  Gene Name: NDRG family member 2
  ENST ID: ENST00000553442
  CDS Start-End: 138-639
gtggggtgtcagtatcccggaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattggg

SEQ ID NO: 158027 - DNA, 603 bp, Homo sapiens
  Payload ID: 10955
  Gene Symbol: NDRG2
  Gene Name: NDRG family member 2
  ENST ID: ENST00000556924
  CDS Start-End: 171-603
gttttggtgagccgagcagagcctggaagcgtccagccgcccgcccctcgccccccggccccagcacaaccctttcctgagcggcagtctgggcgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaacc

SEQ ID NO: 158028 - DNA, 609 bp, Homo sapiens
  Payload ID: 10955
  Gene Symbol: NDRG2
  Gene Name: NDRG family member 2
  ENST ID: ENST00000555142
  CDS Start-End: 150-609
agcgcccgtgggcgggctggggcgggccgggggcgggtctgcgggaagcccgagccggggcgggcccgagtcaaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcc

SEQ ID NO: 158029 - DNA, 559 bp, Homo sapiens
  Payload ID: 10955
  Gene Symbol: NDRG2
  Gene Name: NDRG family member 2
  ENST ID: ENST00000557182
  CDS Start-End: 40-559
aagtgaaggtggaagcggccgcggcggcagcaggccaccatggcggagctgcaggaggtgcagatcacagaggagaagccactgttgccaggacagacgcctgaggcggccaagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggata

SEQ ID NO: 158030 - DNA, 848 bp, Homo sapiens
  Payload ID: 10955
  Gene Symbol: NDRG2
  Gene Name: NDRG family member 2
  ENST ID: ENST00000553867
  CDS Start-End: 93-848
gcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcacc

SEQ ID NO: 158031 - DNA, 580 bp, Homo sapiens
  Payload ID: 10955
  Gene Symbol: NDRG2
  Gene Name: NDRG family member 2
  ENST ID: ENST00000556561
  CDS Start-End: 227-580
gtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtac

SEQ ID NO: 158032 - DNA, 527 bp, Homo sapiens
  Payload ID: 10955
  Gene Symbol: NDRG2
  Gene Name: NDRG family member 2
  ENST ID: ENST00000557633
  CDS Start-End: 1-420
cccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 158033 - DNA, 635 bp, Homo sapiens
  Payload ID: 10955
  Gene Symbol: NDRG2
  Gene Name: NDRG family member 2
  ENST ID: ENST00000556457
  CDS Start-End: 213-635
cttaatctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataatt

SEQ ID NO: 158034 - DNA, 553 bp, Homo sapiens
  Payload ID: 10955
  Gene Symbol: NDRG2
  Gene Name: NDRG family member 2
  ENST ID: ENST00000554379
  CDS Start-End: 72-440
agcccgagccggggcgggcccgagtcaaaggcaagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccagtttctctacaataattggagttggtgttggagctggagcctacatcc

SEQ ID NO: 158035 - DNA, 943 bp, Homo sapiens
  Payload ID: 10955
  Gene Symbol: NDRG2
  Gene Name: NDRG family member 2
  ENST ID: ENST00000553784
  CDS Start-End: 426-943
ttttggtaccctgtcctttagaatactcagtcactgagctacaagtttcactccctacctgagagtgtggggtggcccctaaatatagcccgagaaatctgagctacacttctgccccaccctggtattttggtccagggcagaggagggaggggtctggaggtgtggtgttgagggtggcagtggggatggtgagtatcaagagaagggctgtcctgattcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcc

SEQ ID NO: 158036 - DNA, 775 bp, Homo sapiens
  Payload ID: 10955
  Gene Symbol: NDRG2
  Gene Name: NDRG family member 2
  ENST ID: ENST00000555384
  CDS Start-End: 192-775
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccgga

SEQ ID NO: 158037 - DNA, 871 bp, Homo sapiens
  Payload ID: 10955
  Gene Symbol: NDRG2
  Gene Name: NDRG family member 2
  ENST ID: ENST00000555869
  CDS Start-End: 207-871
ctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacag

SEQ ID NO: 158038 - DNA, 632 bp, Homo sapiens
  Payload ID: 10955
  Gene Symbol: NDRG2
  Gene Name: NDRG family member 2
  ENST ID: ENST00000554561
  CDS Start-End: 273-632
cttgtagcctatattgattccggctcgagcctagagaggacgtgttctctggacttaggggtagacagacactggggagggttagtgacccgaggaggttgatgaccctgggagtctgggtcttggctgaggctttccgtccctgaaagaccccaggtctgtctcccatgtcattcacctcgttgctgtgttttctcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtac

SEQ ID NO: 158039 - DNA, 565 bp, Homo sapiens
  Payload ID: 10955
  Gene Symbol: NDRG2
  Gene Name: NDRG family member 2
  ENST ID: ENST00000554398
  CDS Start-End: 118-565
accccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcct

SEQ ID NO: 158040 - DNA, 1162 bp, Homo sapiens
  Payload ID: 10955
  Gene Symbol: NDRG2
  Gene Name: NDRG family member 2
  ENST ID: ENST00000555026
  CDS Start-End: 344-1162
gtaatctcagcagttttgggaggctgaggagagtagatcacctgagctcaggagtttgagatcagcttatatagatggggaaactcccacctccctaagctaagaggcgttctatcacagtgtgtattttcatcacgagcacacatttttatttacctttcctcttatgaactgtggacttcttacaagatctcattagcaatgtgggctttctcatgtccctgtggctccgtggatgttcccaagcttactggttttggagtcttgcacagcctccttaacgtgaagacaatgaggatgaagacttttatgatgagccacttccactaaacgaatagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaag

SEQ ID NO: 158041 - DNA, 669 bp, Homo sapiens
  Payload ID: 10955
  Gene Symbol: NDRG2
  Gene Name: NDRG family member 2
  ENST ID: ENST00000554531
  CDS Start-End: 206-669
attctaactcacaccactgcttcaccactaccctagtctctctccccatacactataattgggagtcaggcccttgtctcgtcactacactaaccttcatcctttccgtgtctctctttgtcaatctctttctgtctttggtcatttgttggtctgtctttacttgcctctctttgtctgtttgtctctccatctgggacgccacatggtcatgtgtttctgtgtgaatccgtgtgtgtctctccaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtct

SEQ ID NO: 158042 - DNA, 587 bp, Homo sapiens
  Payload ID: 10955
  Gene Symbol: NDRG2
  Gene Name: NDRG family member 2
  ENST ID: ENST00000554472
  CDS Start-End: 144-587
atattgattccggctcgagcctagagaggacgtgttctctggacttaggggtagacagacactggggaggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctgga

SEQ ID NO: 158043 - DNA, 823 bp, Homo sapiens
  Payload ID: 10955
  Gene Symbol: NDRG2
  Gene Name: NDRG family member 2
  ENST ID: ENST00000555695
  CDS Start-End: 38-448
aatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccagtttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaa

SEQ ID NO: 158044 - DNA, 579 bp, Homo sapiens
  Payload ID: 10955
  Gene Symbol: NDRG2
  Gene Name: NDRG family member 2
  ENST ID: ENST00000557616
  CDS Start-End: 127-495
ggcgggcccgagtcaaaggcaagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccagtttctctacaataattgg

SEQ ID NO: 158045 - DNA, 593 bp, Homo sapiens
  Payload ID: 10955
  Gene Symbol: NDRG2
  Gene Name: NDRG family member 2
  ENST ID: ENST00000557264
  CDS Start-End: 144-593
atattgattccggctcgagcctagagaggacgtgttctctggacttaggggtagacagacactggggaggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaa

SEQ ID NO: 158046 - DNA, 561 bp, Homo sapiens
  Payload ID: 10955
  Gene Symbol: NDRG2
  Gene Name: NDRG family member 2
  ENST ID: ENST00000554483
  CDS Start-End: 161-561
aagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggtctgtccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctgg

SEQ ID NO: 158047 - DNA, 531 bp, Homo sapiens
  Payload ID: 10955
  Gene Symbol: NDRG2
  Gene Name: NDRG family member 2
  ENST ID: ENST00000553563
  CDS Start-End: 208-531
attcctcttccaaagcttccaccgatcagcctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactccactgtttcagttcgaggacatgcaggaaatcattcagaactttgtgcgggttcatgtggatgcccctggaatggaagagggagcccctgtgttccctttgggatatcagtacccatctctggaccagcttgcagacatgat

SEQ ID NO: 158048 - DNA, 2880 bp, Homo sapiens
  Payload ID: 10955
  Gene Symbol: NDRG2
  Gene Name: NDRG family member 2
  Uniprot ID: Q9UN36
  ENST ID: ENST00000556147
  CDS Start-End: 942-2057
gtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggtccggggcgcttggcaccggccacgcaagggtgtcagtctccacgcggacgggctgcgtagggactcgtagggacgggttccgggtgctgggcccggccggtctcctctgtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtgtttgtttttaaattgtggagggaaacagccatgctctgctaccctcctcttactggagagctgtcaaaaattttggggatcccctattcccccgcgtttagtccccctgcagatagaaaattgaggccaaatgtagtaactaactggggcaaggtcacactgggagtggcagagccgggattcgaatccggaggttctgacagggccaccctcttacctccacatcagcacttccttctctcctccgcgcagcctgaactgatgcccttgtagcctatattgattccggctcgagcctagagaggacgtgttctctggacttaggggtagacagacactggggagggttagtgacccgaggaggttgatgaccctgggagtctgggtcttggctgaggctttccgtccctgaaagaccccaggtctgtctcccatgtcattcacctcgttgctgtgttttctcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 158049 - DNA, 671 bp, Homo sapiens
  Payload ID: 10955
  Gene Symbol: NDRG2
  Gene Name: NDRG family member 2
  ENST ID: ENST00000556420
  CDS Start-End: 192-671
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaat

SEQ ID NO: 158050 - DNA, 1051 bp, Homo sapiens
  Payload ID: 10955
  Gene Symbol: NDRG2
  Gene Name: NDRG family member 2
  ENST ID: ENST00000556008
  CDS Start-End: 150-1051
aagtgaaggtggaagcggccgcggcggcagcaggtctgtctcccatgtcattcacctcgttgctgtgttttctcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatggg

SEQ ID NO: 158051 - DNA, 583 bp, Homo sapiens
  Payload ID: 10955
  Gene Symbol: NDRG2
  Gene Name: NDRG family member 2
  ENST ID: ENST00000556688
  CDS Start-End: 162-583
gagtcaaaggcaagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataat

SEQ ID NO: 158052 - DNA, 1980 bp, Homo sapiens
  Payload ID: 10955
  Gene Symbol: NDRG2
  Gene Name: NDRG family member 2
  Uniprot ID: Q9UN36
  ENST ID: ENST00000554143
  CDS Start-End: 84-1157
gggtctgcgggaagcccgagccggggcgggcccgagtcaaaggcaagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctg

SEQ ID NO: 158053 - DNA, 2216 bp, Homo sapiens
  Payload ID: 10955
  Gene Symbol: NDRG2
  Gene Name: NDRG family member 2
  Uniprot ID: Q9UN36
  ENST ID: ENST00000555158
  CDS Start-End: 319-1392
agggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 158054 - DNA, 560 bp, Homo sapiens
  Payload ID: 10955
  Gene Symbol: NDRG2
  Gene Name: NDRG family member 2
  ENST ID: ENST00000555767
  CDS Start-End: 210-443
aatctagttctctgtgttcgggcggggggagtcgaactcgtggggtgtcagtatcccgggttcgtctccccactaccggttcccaccactgagtctgggggcgaaggaaggagccagagtgcaattgcagatccagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttg

SEQ ID NO: 158055 - DNA, 978 bp, Homo sapiens
  Payload ID: 10955
  Gene Symbol: NDRG2
  Gene Name: NDRG family member 2
  ENST ID: ENST00000553593
  CDS Start-End: 1-863
aaacagtgtgttggttggctggtggatgggtgtttgtttttaagacactagctctccagcagaaagctggggatagacttcaggtatctaccctgactacccgtgccaacctttggcttcttgggcccttctttttcgcgtcctccaaagaaagtttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcg

SEQ ID NO: 158056 - DNA, 583 bp, Homo sapiens
  Payload ID: 10955
  Gene Symbol: NDRG2
  Gene Name: NDRG family member 2
  ENST ID: ENST00000554419
  CDS Start-End: 197-583
cccacctccccgccttgttgtccaacttctcccggagcagccggagagcaggcgtcgggacgcagcaaagagaggagagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatccct

SEQ ID NO: 158057 - DNA, 2146 bp, Homo sapiens
  Payload ID: 10955
  Gene Symbol: NDRG2
  Gene Name: NDRG family member 2
  ENST ID: ENST00000554104
  CDS Start-End: 468-1322
ctcttccccagtagaaggatggcctctgcttggccctctcttctctctttgctttctttccttctattctagtcctttcccttccctatctctcccctctccttccttcccctcctcttctctctctaatcttcattattctttcttatcctcaaactcatcttccggtatcatgttttcctcaattcttgctgatcctgtttttaattctttgttcccttttccctcttgcccacccactcccagctccctgaccttggtgttgctccttttctggcctcgtctcctctgagcctagctcttggtgccctgttttcctgcagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 158058 - DNA, 578 bp, Homo sapiens
  Payload ID: 10955
  Gene Symbol: NDRG2
  Gene Name: NDRG family member 2
  ENST ID: ENST00000555657
  CDS Start-End: 196-578
aggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattgg

SEQ ID NO: 158059 - DNA, 609 bp, Homo sapiens
  Payload ID: 10955
  Gene Symbol: NDRG2
  Gene Name: NDRG family member 2
  ENST ID: ENST00000556329
  CDS Start-End: 184-609
aagcccgagccggggcgggcccgagtcaaaggcaagtgaaggtggaagcggccgcggcggcagcagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgct

SEQ ID NO: 158060 - DNA, 554 bp, Homo sapiens
  Payload ID: 10955
  Gene Symbol: NDRG2
  Gene Name: NDRG family member 2
  ENST ID: ENST00000554415
  CDS Start-End: 296-554
agcaaagagaggagaggtaccaggactctgggcacgagggagtcggaactcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgagg

SEQ ID NO: 158061 - DNA, 595 bp, Homo sapiens
  Payload ID: 10955
  Gene Symbol: NDRG2
  Gene Name: NDRG family member 2
  ENST ID: ENST00000554094
  CDS Start-End: 73-595
aatgttgaacttgcggagtttattcagagttgggaggaagggtcttgggaggaagggaggcattgggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcc

SEQ ID NO: 158062 - DNA, 573 bp, Homo sapiens
  Payload ID: 10955
  Gene Symbol: NDRG2
  Gene Name: NDRG family member 2
  ENST ID: ENST00000554489
  CDS Start-End: 249-573
agggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggacc

SEQ ID NO: 158063 - DNA, 2162 bp, Homo sapiens
  Payload ID: 10955
  Gene Symbol: NDRG2
  Gene Name: NDRG family member 2
  Uniprot ID: Q9UN36
  ENST ID: ENST00000553503
  CDS Start-End: 265-1338
ggcggcagcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctga

SEQ ID NO: 158064 - DNA, 851 bp, Homo sapiens
  Payload ID: 10955
  Gene Symbol: NDRG2
  Gene Name: NDRG family member 2
  ENST ID: ENST00000557169
  CDS Start-End: 178-851
ctggaaacggagctgggggcaggaaaggccctctgtgtgttctagagtagtcttcaacccctgggtccctctgttccctgcatcttcctgtgctgagagaggaagcctggtgtttgaggcgatgtggggatgtagagacaacttcccagtctcatttcctcatcctgccaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaa

SEQ ID NO: 158065 - DNA, 571 bp, Homo sapiens
  Payload ID: 10955
  Gene Symbol: NDRG2
  Gene Name: NDRG family member 2
  ENST ID: ENST00000557274
  CDS Start-End: 191-571
gaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataatt

SEQ ID NO: 158066 - DNA, 1012 bp, Homo sapiens
  Payload ID: 10955
  Gene Symbol: NDRG2
  Gene Name: NDRG family member 2
  ENST ID: ENST00000556974
  CDS Start-End: 194-1012
acctccccgccttgttgtccaacttctcccggagcagccggagagcaggcgtcgggacgcagcaaagagaggagagaccccagagtcagaaggagtgagaaccctgacccctaatcccactgcatccagccaataggagcccagtaagtgaccccaccccgcaggctgcaggctccttcctgtgcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaag

SEQ ID NO: 158067 - DNA, 772 bp, Homo sapiens
  Payload ID: 10955
  Gene Symbol: NDRG2
  Gene Name: NDRG family member 2
  ENST ID: ENST00000556366
  CDS Start-End: 118-772
gaaaggaagggtgagttctgactgggggacacgagtccctgtctgattctattgttgaggtgatgtgggttctctttagataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgagg

SEQ ID NO: 158068 - DNA, 571 bp, Homo sapiens
  Payload ID: 10955
  Gene Symbol: NDRG2
  Gene Name: NDRG family member 2
  ENST ID: ENST00000554833
  CDS Start-End: 275-571
agggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcat

SEQ ID NO: 158069 - DNA, 924 bp, Homo sapiens
  Payload ID: 10955
  Gene Symbol: NDRG2
  Gene Name: NDRG family member 2
  ENST ID: ENST00000555733
  CDS Start-End: 268-924
cgcggcggcagcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaat

SEQ ID NO: 158070 - DNA, 633 bp, Homo sapiens
  Payload ID: 10955
  Gene Symbol: NDRG2
  Gene Name: NDRG family member 2
  ENST ID: ENST00000557676
  CDS Start-End: 186-633
tagcgcccgtgggcgggctggggcgggccgggggcgggtctgcgggaagcccgagccggggcgggcccgagtcaaaggcaagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttg

SEQ ID NO: 158071 - DNA, 583 bp, Homo sapiens
  Payload ID: 10955
  Gene Symbol: NDRG2
  Gene Name: NDRG family member 2
  ENST ID: ENST00000557149
  CDS Start-End: 124-583
atattgattccggctcgagcctagagaggacgtgttctctggacttagggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcc

SEQ ID NO: 158072 - DNA, 672 bp, Homo sapiens
  Payload ID: 10955
  Gene Symbol: NDRG2
  Gene Name: NDRG family member 2
  ENST ID: ENST00000635386
  CDS Start-End: 1-672
ataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgacctcgttcctcaagatggctgactccggaggtcagccccagctgactcagccaggcaagctgaccgaggccttcaagtact

SEQ ID NO: 158073 - DNA, 2964 bp, Homo sapiens
  Payload ID: 10956
  Gene Symbol: NDRG3
  Gene Name: NDRG family member 3
  Uniprot ID: Q9UGV2
  ENST ID: ENST00000349004
  CDS Start-End: 83-1210
gctgctgcactgacggcgggtgcccgcgcctcagagttactgatttattcttgagattcctctactctcgttatctgacctcatggatgaacttcaggatgttcagctcacagagatcaaaccacttctaaatgataagaatggtacaagaaacttccaggactttgactgtcaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgttacctga

SEQ ID NO: 158074 - DNA, 2917 bp, Homo sapiens
  Payload ID: 10956
  Gene Symbol: NDRG3
  Gene Name: NDRG family member 3
  Uniprot ID: Q9UGV2
  ENST ID: ENST00000359675
  CDS Start-End: 72-1163
gacggcgggtgcccgcgcctcagagttactgatttattcttgagattcctctactctcgttatctgacctcatggatgaacttcaggatgttcagctcacagagatcaaaccacttctaaatgataaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgttacctga

SEQ ID NO: 158075 - DNA, 2098 bp, Homo sapiens
  Payload ID: 10956
  Gene Symbol: NDRG3
  Gene Name: NDRG family member 3
  ENST ID: ENST00000373773
  CDS Start-End: 111-953
tcagagttactgatttattcttgagattcctctactctcgttatctgacctcatggatgaacttcaggatgttcagctcacagagatcaaaccacttctaaatgataagaatggtacaagaaacttccaggactttgactgtcaggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgca

SEQ ID NO: 158076 - DNA, 2978 bp, Homo sapiens
  Payload ID: 10956
  Gene Symbol: NDRG3
  Gene Name: NDRG family member 3
  ENST ID: ENST00000373803
  CDS Start-End: 58-1224
gcgcctcagagttactgatttattcttgagattcctctactctcgttatctgacctcatggatgaacttcaggatgttcagctcacagagatcaaaccacttctaaatgataagaatggtacaagaaacttccaggactttgactgtcaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacatcccgtatgtgcagctcagtcacctgagcaccgagtcagtaccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgttacctga

SEQ ID NO: 158077 - DNA, 736 bp, Homo sapiens
  Payload ID: 10956
  Gene Symbol: NDRG3
  Gene Name: NDRG family member 3
  ENST ID: ENST00000422536
  CDS Start-End: 176-736
attgtgtagtcacactctagaatgctggggtgggagatgagataactggatagagagcctgtaaaacagatgataattgactaagacaaaaaggtagcaacagcacgttactccctgcagtggcctgacaactgaatcagctccttagccagggtctctgcacattcatcttcagatggagtttttttcaagctgttcattcacaaggtcacgaaaaatatgcatgccaatcaccatggaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcag

SEQ ID NO: 158078 - DNA, 3324 bp, Homo sapiens
  Payload ID: 10957
  Gene Symbol: NDRG4
  Gene Name: NDRG family member 4
  Uniprot ID: Q9ULP0
  ENST ID: ENST00000258187
  CDS Start-End: 157-1272
ccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctcatttctgctt

SEQ ID NO: 158079 - DNA, 1375 bp, Homo sapiens
  Payload ID: 10957
  Gene Symbol: NDRG4
  Gene Name: NDRG family member 4
  Uniprot ID: Q9ULP0
  ENST ID: ENST00000356752
  CDS Start-End: 107-1216
acagagccgaccatctcccactcgagctgcccccgccctctggacccgagtgactcaggcctttgtttgtccttcctggtagaggcgggttccctccctcggcaagatgccggagtgctgggatggggtgggggaaggcaacgctggagccgtgaagctggcagggctaggggaccccaggtggagcccagggcacctcctctcgccggggcatcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtct

SEQ ID NO: 158080 - DNA, 3431 bp, Homo sapiens
  Payload ID: 10957
  Gene Symbol: NDRG4
  Gene Name: NDRG family member 4
  Uniprot ID: Q9ULP0
  ENST ID: ENST00000394279
  CDS Start-End: 274-1389
gacccgcgccatggacctcttatttctgcgccctgtgacaatctgagccgtctttctctgggggagaagtttcttgctgggagtggaggcgacgccaagtggcctgggaagtgggaagccagattggaccctactgactggggaccctcagccttggggctcctctggagaagtgatcagttgccctgctggaaactcacatccagggggcagtggctggagagcaagagcgaacggtcaggaagaggaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctc

SEQ ID NO: 158081 - DNA, 3626 bp, Homo sapiens
  Payload ID: 10957
  Gene Symbol: NDRG4
  Gene Name: NDRG family member 4
  Uniprot ID: Q9ULP0
  ENST ID: ENST00000394282
  CDS Start-End: 408-1583
ggccgcgctggggacccccagccgccgtccgcgaccccccaccgcgacgcccggaggcggcggggtctctttgttcgggcggcgggcacgggggaccacctcccacggtgtcaccgcacccaccccgcgcccttcctccgcctcctggagttcaccgggaccaggtggcggcgggtgcctttttgggggtgcgcggccatgcaattggtggatttttttaaaccgttttggaggggggagcgcggcgttgggggcgggagagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctca

SEQ ID NO: 158082 - DNA, 705 bp, Homo sapiens
  Payload ID: 10957
  Gene Symbol: NDRG4
  Gene Name: NDRG family member 4
  ENST ID: ENST00000564126
  CDS Start-End: 109-705
ctggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgg

SEQ ID NO: 158083 - DNA, 461 bp, Homo sapiens
  Payload ID: 10957
  Gene Symbol: NDRG4
  Gene Name: NDRG family member 4
  ENST ID: ENST00000569408
  CDS Start-End: 1-244
ggccaacctgcagctcttctggaacatgtacaacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttc

SEQ ID NO: 158084 - DNA, 558 bp, Homo sapiens
  Payload ID: 10957
  Gene Symbol: NDRG4
  Gene Name: NDRG family member 4
  ENST ID: ENST00000567063
  CDS Start-End: 307-558
tcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatc

SEQ ID NO: 158085 - DNA, 599 bp, Homo sapiens
  Payload ID: 10957
  Gene Symbol: NDRG4
  Gene Name: NDRG family member 4
  ENST ID: ENST00000568464
  CDS Start-End: 107-298
acagagccgaccatctcccactcgagctgcccccgccctctggacccgagtgactcaggcctttgtttgtccttcctggtagaggcgggttccctccctcggcaagatgccggagtgctgggatggggtgggggaaggcaacgctggagccgtgaagctggcagggctaggggaccccaggtggagcccagggcacctcctctcgccggggcatcagccccaccctccagagctgagagaactcacaggtggctgtgaaagggctgcctggtcaggagctccctcgggtggaacctgatctcctgtgaacatgcagccttcagtgcaccgccctggcccctgagactggcacctggcagggcctgccctccctactctgggattgaccttgggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggg

SEQ ID NO: 158086 - DNA, 3265 bp, Homo sapiens
  Payload ID: 10957
  Gene Symbol: NDRG4
  Gene Name: NDRG family member 4
  Uniprot ID: Q9ULP0
  ENST ID: ENST00000566192
  CDS Start-End: 203-1222
gtaagcgagtggctgctcagaaaccctgcggggaggaggggctagctaggctgggccaggatccctgtataaatggcccaggagctgtgccccatcacagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctca

SEQ ID NO: 158087 - DNA, 590 bp, Homo sapiens
  Payload ID: 10957
  Gene Symbol: NDRG4
  Gene Name: NDRG family member 4
  ENST ID: ENST00000567667
  CDS Start-End: 143-590
acctgcacccgcgcgtcggcggcgccgaagccccgctccccgcctgcgcgtctgtctcgtccgcatctccgcggatctcaaaatagaggattcccaaatcatggcttcatgattctcaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcct

SEQ ID NO: 158088 - DNA, 533 bp, Homo sapiens
  Payload ID: 10957
  Gene Symbol: NDRG4
  Gene Name: NDRG family member 4
  ENST ID: ENST00000565304
  CDS Start-End: 99-533
gcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcagtgagtctcccc

SEQ ID NO: 158089 - DNA, 556 bp, Homo sapiens
  Payload ID: 10957
  Gene Symbol: NDRG4
  Gene Name: NDRG family member 4
  ENST ID: ENST00000568999
  CDS Start-End: 89-556
ttttcaggccatcagatttccgtactccctggagtgggacttcatctgggaccaaaggagggctggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgca

SEQ ID NO: 158090 - DNA, 545 bp, Homo sapiens
  Payload ID: 10957
  Gene Symbol: NDRG4
  Gene Name: NDRG family member 4
  ENST ID: ENST00000566041
  CDS Start-End: 429-545
gcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggacccgcgccatggacctcttatttctgcgccctgtgacaatctgagccgtctttctctgggggagaagtttcttgctgggagtggaggcgacgccaagtggcctgggaagtgggaagccagattggaccctactgactggggaccctcagccttggggctcctctggagaagtgatcagttgccctgctggaaactcacatccagggggcagtggctggagagcaagagcgaacggtcaggaagaggaggcctcctgctccacgacgtgaccatggccgggctgcaggagctgcgattccctgaggagaagccgctgctccggggccaggacgccaccgagctggagagctccgatgccttcctcttggctgcagacacagactggaag

SEQ ID NO: 158091 - DNA, 573 bp, Homo sapiens
  Payload ID: 10957
  Gene Symbol: NDRG4
  Gene Name: NDRG family member 4
  ENST ID: ENST00000561738
  CDS Start-End: 1-573
tgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggagctggtgaacaacacagagttggtgcagagctaccggcagcagattgggaacgtggtgaaccaggccaacctgcagctcttctggaacatgtacaacagccgcagagacct

SEQ ID NO: 158092 - DNA, 590 bp, Homo sapiens
  Payload ID: 10957
  Gene Symbol: NDRG4
  Gene Name: NDRG family member 4
  ENST ID: ENST00000569404
  CDS Start-End: 118-590
gaggggctcctggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaaggtgggggaaggcaacgctggagccgtgaagctggcagggctaggggaccccaggtggagcccagggcacctcctctcgccggggcatcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgct

SEQ ID NO: 158093 - DNA, 550 bp, Homo sapiens
  Payload ID: 10957
  Gene Symbol: NDRG4
  Gene Name: NDRG family member 4
  ENST ID: ENST00000564207
  CDS Start-End: 90-550
acagggggcctggaggggcgggcagggcctcgcagcgcacccagcacagtccgcgcggcggagcgggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaa

SEQ ID NO: 158094 - DNA, 610 bp, Homo sapiens
  Payload ID: 10957
  Gene Symbol: NDRG4
  Gene Name: NDRG family member 4
  ENST ID: ENST00000567454
  CDS Start-End: 150-610
agagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggcctcctgctccacgacgtgaccatggccgggctgcaggagctgcgattccctgaggagaagccgctgctccggggccaggacgccaccgagctggagagctccgatgccttcctcttggctgcagacacagactggaagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggta

SEQ ID NO: 158095 - DNA, 566 bp, Homo sapiens
  Payload ID: 10957
  Gene Symbol: NDRG4
  Gene Name: NDRG family member 4
  ENST ID: ENST00000565430
  CDS Start-End: 232-566
tcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggatctcaaaatagaggattcccaaatcatggcttcatgattctcaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtt

SEQ ID NO: 158096 - DNA, 583 bp, Homo sapiens
  Payload ID: 10957
  Gene Symbol: NDRG4
  Gene Name: NDRG family member 4
  ENST ID: ENST00000569026
  CDS Start-End: 1-464
tgcagctcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagtgccctcagccagcatgacccgcctggcacgctcccgcactgcatccctcaccagtgccagctcggtggatggcagccgcccacaggcctgcacccactcagagagcagcgaggggctgggccaggtcaaccacacc

SEQ ID NO: 158097 - DNA, 610 bp, Homo sapiens
  Payload ID: 10957
  Gene Symbol: NDRG4
  Gene Name: NDRG family member 4
  ENST ID: ENST00000562764
  CDS Start-End: 191-313
aaacccacgcgggcacgcccccgcggcgcaccgcccccagcccggcctccgcccctgcagccgcgggcacgcggaggggctcctggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaaggcctaacaggtaccaggctgcgtcacctcattccccagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgt

SEQ ID NO: 158098 - DNA, 563 bp, Homo sapiens
  Payload ID: 10957
  Gene Symbol: NDRG4
  Gene Name: NDRG family member 4
  ENST ID: ENST00000562930
  CDS Start-End: 107-223
acagagccgaccatctcccactcgagctgcccccgccctctggacccgagtgactcaggcctttgtttgtccttcctggtagaggcgggttccctccctcggcaagatgccggagtgctgggatggggtgggggaaggcaacgctggagccgtgaagctggcagggctaggggaccccaggtggagcccagggcacctcctctcgccggggcatcaggcctaacaggtaccaggctgcgtcacctcattccccagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagct

SEQ ID NO: 158099 - DNA, 558 bp, Homo sapiens
  Payload ID: 10957
  Gene Symbol: NDRG4
  Gene Name: NDRG family member 4
  ENST ID: ENST00000563978
  CDS Start-End: 308-558
acagagccgaccatctcccactcgagctgcccccgccctctggacccgagtgactcaggcctttgtttgtccttcctggtagaggcgggttccctccctcggcaagatgccggagtgctgggatggggcctaacaggtaccaggctgcgtcacctcattccccagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccgacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtgga

SEQ ID NO: 158100 - DNA, 697 bp, Homo sapiens
  Payload ID: 10957
  Gene Symbol: NDRG4
  Gene Name: NDRG family member 4
  ENST ID: ENST00000564486
  CDS Start-End: 179-697
agagcaagagcgaacggtcaggaagaggaggtgggaaagggagcagggacgggggggaggattcgaggagtgacttctgtgttctccccggtgtggagagacccagacaggaggaaaggaaagcaacccggtttcctccagctctgggacttataggtgctccatccgtgtatgtcagatgagcacagattccagcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcagtgagtctcccc

SEQ ID NO: 158101 - DNA, 2931 bp, Homo sapiens
  Payload ID: 10957
  Gene Symbol: NDRG4
  Gene Name: NDRG family member 4
  ENST ID: ENST00000562999
  CDS Start-End: 107-1090
acagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaatt

SEQ ID NO: 158102 - DNA, 585 bp, Homo sapiens
  Payload ID: 10957
  Gene Symbol: NDRG4
  Gene Name: NDRG family member 4
  ENST ID: ENST00000561724
  CDS Start-End: 134-585
aaagcccttaccagctgcagagtattcactctgtgcttggcctatgtggacggagcagaggagcagttgtcagagatgacccagaggtcccttgcaacccacaacctaaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgt

SEQ ID NO: 158103 - DNA, 1281 bp, Homo sapiens
  Payload ID: 10957
  Gene Symbol: NDRG4
  Gene Name: NDRG family member 4
  Uniprot ID: Q9ULP0
  ENST ID: ENST00000568640
  CDS Start-End: 143-1216
atccctgtataaatggcccaggagctgtgccccatcacagagccgaccatctcccactcgagctgcccccgccctctggacccgagtgactcaggcctttgtttgtccttcctggtagaggcgggttccctccctcggcaagatgccggagtgctgggatgggaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgt

SEQ ID NO: 158104 - DNA, 747 bp, Homo sapiens
  Payload ID: 10957
  Gene Symbol: NDRG4
  Gene Name: NDRG family member 4
  ENST ID: ENST00000565434
  CDS Start-End: 322-747
aatcagtgtcgcttgtcccctaagaaaggacccgtgggcttctggcaggacccgcgccatggacctcttatttctgcgccctgtgacaatctgagccgtctttctctgggggagaagtttcttgctgggagtggaggcgacgccaagtggcctgggaagtgggaagccagattggaccctactgactggggaccctcagccttggggctcctctggagaagtgatcagttgccctgctggaaactcacatccagggggcagtggctggagagcaagagcgaacggtcaggaagaggaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggc

SEQ ID NO: 158105 - DNA, 574 bp, Homo sapiens
  Payload ID: 10957
  Gene Symbol: NDRG4
  Gene Name: NDRG family member 4
  ENST ID: ENST00000566061
  CDS Start-End: 114-311
gctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggcctcctgctccacgacgtgaccatggccgggctgcaggagctgcgattccctgaggagaagccgctgctccggggccaggacgccaccgagctggagagctccgatgccttcctcttggctgcagacacagactggaagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgca

SEQ ID NO: 158106 - DNA, 581 bp, Homo sapiens
  Payload ID: 10957
  Gene Symbol: NDRG4
  Gene Name: NDRG family member 4
  ENST ID: ENST00000566618
  CDS Start-End: 255-581
agagtgcaccgcgctgtggcccttgtggggctgcccttgcgcagcgctccaagggacggggatgtttggcttcgatcaggctgaactgagtcctgagctctccgcagagggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacg

SEQ ID NO: 158107 - DNA, 575 bp, Homo sapiens
  Payload ID: 10957
  Gene Symbol: NDRG4
  Gene Name: NDRG family member 4
  ENST ID: ENST00000562731
  CDS Start-End: 470-575
agagccgaccatctcccactcgagctgcccccgccctctggacccgagtgactcaggcctttgtttgtccttcctggtagaggcgggttccctccctcggcaagatgccggagtgctgggatggggaggcgcattgcagttcttttgcagccccaccctccagagctgagagaactcacaggtggctgtgaaagggctgcctggtcaggagctccctcgggtggaacctgatctcctgtgaacatgcagccttcagtgcaccgccctggcccctgagactggcacctggcagggcctgccctccctactctgggattgaccttgggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagc

SEQ ID NO: 158108 - DNA, 1312 bp, Homo sapiens
  Payload ID: 10957
  Gene Symbol: NDRG4
  Gene Name: NDRG family member 4
  ENST ID: ENST00000569923
  CDS Start-End: 364-1218
acagagccgaccatctcccactcgagctgcccccgccctctggacccgagtgactcaggcctttgtttgtccttcctggtagaggcgggttccctccctcggcaagatgccggagtgctgggatggggcctaacaggtaccaggctgcgtcacctcattccccagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaa

SEQ ID NO: 158109 - DNA, 590 bp, Homo sapiens
  Payload ID: 10957
  Gene Symbol: NDRG4
  Gene Name: NDRG family member 4
  ENST ID: ENST00000565088
  CDS Start-End: 160-590
agctaggctgggccaggatccctgtataaatggcccaggagctgtgccccatcacagagccgaccatctcccactcgagctgcccccgccctctggacccgagtgactcaggcctttgtttgtccttcctggtagaggcgggttccctccctcggcaagatgccggagtgctgggatggggtgggggaaggcaacgctggagccgtgaagctggcagggctaggggaccccaggtggagcccagggcacctcctctcgccggggcatcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtggg

SEQ ID NO: 158110 - DNA, 618 bp, Homo sapiens
  Payload ID: 10957
  Gene Symbol: NDRG4
  Gene Name: NDRG family member 4
  ENST ID: ENST00000569539
  CDS Start-End: 233-618
ctcctggctgcccgcacctgcacccgcgcgtcggcggcgccgaagccccgctccccgcctgcgcgtctgtctcgtccgcatctccgcggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagag

SEQ ID NO: 158111 - DNA, 579 bp, Homo sapiens
  Payload ID: 10957
  Gene Symbol: NDRG4
  Gene Name: NDRG family member 4
  ENST ID: ENST00000564867
  CDS Start-End: 150-287
agagcgctcctggctgtgagctgctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggatctcaaaatagaggattcccaaatcatggcttcatgattctcaggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggg

SEQ ID NO: 158112 - DNA, 3207 bp, Homo sapiens
  Payload ID: 10957
  Gene Symbol: NDRG4
  Gene Name: NDRG family member 4
  Uniprot ID: Q9ULP0
  ENST ID: ENST00000570248
  CDS Start-End: 107-1165
acagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacattgcgtacttgaaggaccgaaggctgagtggaggagcagtgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctc

SEQ ID NO: 158113 - DNA, 549 bp, Homo sapiens
  Payload ID: 10957
  Gene Symbol: NDRG4
  Gene Name: NDRG family member 4
  ENST ID: ENST00000566656
  CDS Start-End: 356-549
aatgggagtgctcggccctgagggttgggggcctcagagtgcaccgcgctgtggcccttgtggggctgcccttgcgcagcgctccaagggacggggatgtttggcttcgatcaggctgaactgagtcctgagctctccgcagagggtgagagaaggcgttagggaggttcgcagcagggttcagcgaaggtcactggacttcgtaggacaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgct

SEQ ID NO: 158114 - DNA, 564 bp, Homo sapiens
  Payload ID: 10957
  Gene Symbol: NDRG4
  Gene Name: NDRG family member 4
  ENST ID: ENST00000568424
  CDS Start-End: 508-564
gagccgaccatctcccactcgagctgcccccgccctctggacccgagtgactcaggcctttgtttgtccttcctggtagaggcgggttccctccctcggcaagatgccggagtgctgggatgggcaggaggcgcattgcagttcttttgcagccccaccctccagagctgagagaactcacaggtggctgtgaaagggctgcctggtcaggagctccctcgggtggaacctgatctcctgtgaacatgcagccttcagtgcaccgccctggcccctgagactggcacctggcagggcctgccctccctactctgggattgaccttgggcctaacaggtaccaggctgcgtcacctcattccccagaggagccaagagcggaggctgcccagagtgtccagcacggtctctccccttcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggaca

SEQ ID NO: 158115 - DNA, 587 bp, Homo sapiens
  Payload ID: 10957
  Gene Symbol: NDRG4
  Gene Name: NDRG family member 4
  ENST ID: ENST00000561779
  CDS Start-End: 128-587
gctcctgccgcttcgctccgcgctctcctgccgctccgctccgggtctcccgcgctcctctccccggctcggccgagcgcgctgccccgacgccgccacccagagccgggccgcgccgggcgccgagatgaaggtgctgggacaccggctggagctgctcacaggcctcctgctccacgacgtgaccatggccgggctgcaggagctgcgattccctgaggagaagccgctgctccggggccaggacgccaccgagctggagagctccgatgccttcctcttggctgcagacacagactggaaggtgggggaaggcaacgctggagccgtgaagctggcagggctaggggaccccaggtggagcccagggcacctcctctcgccggggcatcaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctg

SEQ ID NO: 158116 - DNA, 3014 bp, Homo sapiens
  Payload ID: 10957
  Gene Symbol: NDRG4
  Gene Name: NDRG family member 4
  Uniprot ID: Q9ULP0
  ENST ID: ENST00000563799
  CDS Start-End: 107-1180
acagagccgaccatctcccactcgagctgcccccgccctctggacccgagtgactcaggcctttgtttgtccttcctggtagaggcgggttccctccctcggcaagatgccggagtgctgggatggggaacatgacatcgagacaccctacggccttctgcatgtagtgatccggggctcccccaaggggaaccgcccagccatcctcacctaccatgatgtgggcctcaaccgtaagtgcagcccagcctcagtcagccctcctctgcctcccatcagccagagcgacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaag

SEQ ID NO: 158117 - DNA, 2130 bp, Homo sapiens
  Payload ID: 10958
  Gene Symbol: NDUFA4
  Gene Name: NDUFA4, mitochondrial complex associated
  Uniprot ID: O00483
  ENST ID: ENST00000339600
  CDS Start-End: 200-445
agatctaagcaggcactattaaagacagtcgcatccgggccctcctgccgcaagctgccctcccagccaagggtccttcaggtaggaggtcctgggtgactttggaagtccgtagtgtctcattgcagataatttttagcttagggcctggtggctaggtcggttctctcctttccagtcggagacctctgccgcaaacatgctccgccagatcatcggtcaggccaagaagcatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgtaatctctattggagattacaatgattaaatcaataaataactgaaacttgatatgtgtcacttttttatgctgaaagtatgctctgaactttagagtataggaaattaactattagaatttaaagaatttcttgaatttctgtagtttgaaaatacgactttaagctgctttagtaaaacacttccattttgtgtatagactgttggtaacttcactagagcatacataacaactggaactggaaattatacaaaagtaaattgggaaggatactccagcatctgacactggcaaaatggaaacctttgagtttctcttactggctgttgaagtgtgtgcagtttttaacaatggtttttacttggcatctctttgttgtgattttcaaggttataagttgctttggtcctaggattgaagttgaaatctgagtttatcagtgctaaccatggtgctagtagtcaagagatcttgagaattttggctgctgagtcttggtgcagggtgcaggttttcttttcttttttcttttttttttttttgagatagtctctgtcacccaggctggagtgcagtggtacaaacatggatcactgcagcctctacctcccgggcttaagtgatcctcctgcctcagcccctaagtagccgggactacaggtatgtgccaccatgcccagttaatttttgtaattttttttagagacagggttttgccatgttgcccaggctggtctcaaactcttgagctcaagcgatccattctcctcagcctcccagggtgctgggattacaggcgtgagccattgcgcttagccatggtgcaggttttcaaaggccaggaagtatattcataattttaagatggggaatatagcaagttttcacataggtgtgtgtaagtcatcacatcatagaaacttgaggaattcagtgacattaattttggattttcatacgtaagtatacaattaaatgtttacagggtagtagaagcacattttaaatgtcaggaactgaactaagtatttgaattacgtggattatctcaaaaattttgaaattgttaaacgagttgaattacttgaattcattctgttagtcaaatggtggatatttacacccatgtagttttgaatttagagtgtgtagagtgttttcagttaccagactccatgcttttacctcctatgtgtcaggtataatttgaacctctaagaacagggtttctcaaccttgccactgttgactatttctgaaagacagtttggtttagcagaccatcccatgcgctttagcttgtttagtagctaacttgggctctgccactacagacaaaaagcactctttccctccaattcccacaggctatgagaagaatggagacattaccaaatgtccattggtgggcaaaattgcttcattcctacctctgttgagaattactctagatcctttggcacaaattacctcaaagtttaaaattgtgtaaacaaacagtgtgtcatgtaattgaaaaacattaagcaactccaaataaatgctacattaagaa

SEQ ID NO: 158118 - DNA, 656 bp, Homo sapiens
  Payload ID: 10959
  Gene Symbol: NDUFC2-KCTD14
  Gene Name: NDUFC2-KCTD14 readthrough
  Uniprot ID: E9PQ53
  ENST ID: ENST00000530054
  CDS Start-End: 122-466
cgtgagtccggcgcgcagaggaggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaa

SEQ ID NO: 158119 - DNA, 566 bp, Homo sapiens
  Payload ID: 10959
  Gene Symbol: NDUFC2-KCTD14
  Gene Name: NDUFC2-KCTD14 readthrough
  ENST ID: ENST00000528251
  CDS Start-End: 101-301
aggaggagaaagctgaccgcttaggccggggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctgatgtctactgttgtggagctgaacgtcgggggtgagttccacaccaccaccctgggtaccctgaggaagtttccgggctcaaagctggcagagatgttctctagcttagccaaggcctccacggacgcggagggccgcttcttcatcgaccgccccagcacctatttcagacccatcctggactacctgcgcactgggcaagtgcccacacagcacatccctgaagtgtaccgtgaggctcagttctacgaaatcaagcctttggtcaagctgctggaggacatgccacagatctttggt

SEQ ID NO: 158120 - DNA, 530 bp, Homo sapiens
  Payload ID: 10959
  Gene Symbol: NDUFC2-KCTD14
  Gene Name: NDUFC2-KCTD14 readthrough
  ENST ID: ENST00000612612
  CDS Start-End: 30-434
accaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctggtttgcatcgccagcttctatatattacggcctttttttttgctggatattatcttgtaaaacgtgaagactacctgtatgctgtgagggaccgtgaaatgtttggatatatgaaattacatccagaggattttcctgaagaagggggtgacattggcctctgttgcttgtccccaggatccctctctgacacccctgctgtgtttgctgtggggagttctgctgccaccacccattagatgtctactgttgtggagctgaacgtcgggggtgagttccacaccaccaccctgggtaccctgaggaagtttccgggctcaaagctggcagagatg

SEQ ID NO: 158121 - DNA, 386 bp, Homo sapiens
  Payload ID: 10959
  Gene Symbol: NDUFC2-KCTD14
  Gene Name: NDUFC2-KCTD14 readthrough
  ENST ID: ENST00000614236
  CDS Start-End: 30-290
accaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctaatccggcggaggccgatcgcgacggctgggggtgacattggcctctgttgcttgtccccaggatccctctctgacacccctgctgtgtttgctgtggggagttctgctgccaccacccattagatgtctactgttgtggagctgaacgtcgggggtgagttccacaccaccaccctgggtaccctgaggaagtttccgggctcaaagctggcagagatg

SEQ ID NO: 158122 - DNA, 9216 bp, Homo sapiens
  Payload ID: 10960
  Gene Symbol: NEBL
  Gene Name: nebulette
  Uniprot ID: O76041
  ENST ID: ENST00000377122
  CDS Start-End: 398-3442
cttgagtgttagagctgagtagttttcccagaatctctaagtcctttttatgctcttttatgaatgaatagaattagtaaaagataaataaattttttcttttggatttcttaaccagtggaaaaaatgttgactttaaaagttcataaaatcaaattttgcttaagaatatgttatttccacttgtgaggccagcctggtagacctctgggatccttttctgttcactcacacaccactgagataaggagtgaagtgtgggctaaatagggctgaggcttgggcaagggcatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacacctggtgctgctaattgtgttcatggtttcctttgattggctattgaacccttctgggaaatgtatttttgtagactttaatagagaagttgattgtcccttaaatgtagtgtgtgtttgaaacttcttagctgtcactttggaatcaccccaagccaattctcttaactctgtaatgcagccaataatttcaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagttttgaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtatcttcttttggaaaatggtattcaaattctggaatggaaatctagccaccaaaacgggttaatcaaaagacgtccttttccatttttttttgcttttattttctaaatcatttttaagggaatgaaacaggaatgtcatcagagattttttagtacaggcccaagagcctgttctctaagaaagaaattgttgccatgttttgattttcgaataagtgactttgcaggctttatgctagcccttgctggtgggtcttgaaatttcatccagagtctgcagtccaggtcaccaagccagcggcacccgtcggcaaccctgtgtttttctgattgtgccgtttactgtgacctgcaacggggtggcattcacttagggtctgacttcacagctatgacaaaaccgaaaaagcaaaactgcaaaaaagtactaagatgtacgggtcttggggatatctgccttatatgttatattcaaggaaattaacaaaacatcctgtaaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggttttctctcactgaaatggccagtcgtgattaaagtgataaaaccccatatctgttttggtatattgtacacaaacctacaaaaataaactgaacttgcaatatttttgcaaaaaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcacatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgctcttgaggccataatttggtagtgttggcagttgttaataaagcttgtcaggatgttaagcatctcaggagaaatattggaaaattatatgtataaaaccaaagtgctatttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtagaaatgctttaattcatatttttttcctctacactgtgaatctttaagccttggtggactagagcaacatcgtgctgcccaaaggactaacctatgcaaactagttcacattttagtggatgtcgcagttaatgtgtaataagacattatttcccctgcataatgtacaacagcattgaaatgacacattaagcctagcatcacattgtatagtacagtcactcacaaacccttcaaggctaccctaatcattaacattaatatttgtttaaaagcaaatcaccgatttatctattgaaactacttaaatgacggcaaaccaggaatgacagatggctgtgtcagcaatggctttaatgtgttccctgcaagtggtctcctatgatagaactgcgttctcaaatgcactctcttcagggtcttaatattctgtgttttctctctgtatttgtaaaacattataacacattaatttcctatctctacacatttggtttgcttaaataaatgcaggatataaaaaaaatggttcacttcttggctctcaccgtggtttcttggagcatgggttgttagatgcaagcaatgcaccctaataataccccgggtctgagatttaacatgacaactcacatcaaatcgcatcagaggtgtgtgctgccttcagtgcatttacattggtgaatcagtcaagatattttcctcccccaaataaacttagttgtaagtgataacaatattatgcttctccaagctcagtatctttctgattttatatcaaagtaccgcaacaatgcatcattgtagttaatttatttcaagaataaattcctcatatgtcctcaatagtacaattctaattttcttctattcataagatgaaagaaatggtttggagcatagaatagaaagtgcacaaattgagtacataaaatgggaagcaactgatttctcagctaagaaaggctcatttatcacagaacacaattgcttttctccccccactacgcttcccataattgaaaaagtgagtccctatttttcacactcatataaatctatgcgatttggatgctagtcttattgtattattttgtaaaactttctctttggctcataatccttcctaattgtaaattgataaactttgcggatgacatctgctcgtagaataaacacttcttccaaa

SEQ ID NO: 158123 - DNA, 3008 bp, Homo sapiens
  Payload ID: 10960
  Gene Symbol: NEBL
  Gene Name: nebulette
  Uniprot ID: O76041
  ENST ID: ENST00000417816
  CDS Start-End: 355-1167
cctgcgcggcggcggcggcgaggcgggggagcgagtgagcgcgaggggcgggcgcgagtgactgtgtgagtcacccgtacctggagtgcgagcgacgcagagccagcggcgcggagccggagccggagccgagacccagcgcctgcgagcccgagagcgcggccggccccaggcgccaggccccgtcgccctccccgtgcactcacccgtggcccggcgccgactccctacccggcgcccgccgcccgcagccctcccgcctgccaggaggcggtgcggggctcgccgggggatgtcacagcggctcctgggagccagcagccgccgccgccgccgcccccgggaaccgcgatcatgaacccccagtgcgcccgttgcggaaaagtcgtgtatcccaccgagaaagtcaactgcctggataagtattggcataaaggatgtttccattgtgaggtctgcaagatggcactcaacatgaacaactacaaaggctatgaaaagaagccctattgtaatgcacactacccgaagcagtccttcaccacggtggcagatacacctgaaaatcttcgcctgaagcagcaaagtgaattgcagagtcaggtcaagtacaaaagagattttgaagaaagcaaagggaggggcttcagcatcgtcacggacactcctgagctacagagactgaagaggactcaggagcaaatcagtaatgtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacacctggtgctgctaattgtgttcatggtttcctttgattggctattgaacccttctgggaaatgtatttttgtagactttaatagagaagttgattgtcccttaaatgtagtgtgtgtttgaaacttcttagctgtcactttggaatcaccccaagccaattctcttaactctgtaatgcagccaataatttcaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagttttgaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtatcttcttttggaaaatggtattcaaattctggaatggaaatctagccaccaaaacgggttaatcaaaagacgtccttttccatttttttttgcttttattttctaaatcatttttaagggaatgaaacaggaatgtcatcagagattttttagtacaggcccaagagcctgttctctaagaaagaaattgttgccatgttttgattttcgaataagtgactttgcaggctttatgctagcccttgctggtgggtcttgaaatttcatccagagtctgcagtccaggtcaccaagccagcggcacccgtcggcaaccctgtgtttttctgattgtgccgtttactgtgacctgcaacggggtggcattcacttagggtctgacttcacagctatgacaaaaccgaaaaagcaaaactgcaaaaaagtactaagatgtacgggtcttggggatatctgccttatatgttatattcaaggaaattaacaaaacatcctgtaaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcagg

SEQ ID NO: 158124 - DNA, 633 bp, Homo sapiens
  Payload ID: 10960
  Gene Symbol: NEBL
  Gene Name: nebulette
  ENST ID: ENST00000434381
  CDS Start-End: 282-633
gttctgatcctagtgcttcattgaatggctttgtaaatgagacacataatttttcatagccttcattttgtcatctgtgaaagagagggctttaggtgtattgatttcttaaggatccctttggcttgaaattctgattctagaatctcaaatggaaaatttgtgttcacattgcacgtggtgtttggtttttgttttcaaaagtttgtgcattaaatctcaacagcttattttcttgcagcacagtgaagagtccctaagaacatattacgtgatgggaaatgagaaataactgcactgcaagcctgatgaaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgcca

SEQ ID NO: 158125 - DNA, 703 bp, Homo sapiens
  Payload ID: 10960
  Gene Symbol: NEBL
  Gene Name: nebulette
  ENST ID: ENST00000460652
  CDS Start-End: 1-346
gaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggtaaaatataagggagaacttcaacggggaactgcaatttctgatccaccagagctgaagagggcaaaagaaaaccagaaaaacatcagcaatgtgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtagggtccaaccagatcattcttaaaacatgctaaggaatgggcggatccagtgcacggatggcattacttcactattaatccgataactaacaaagcatggaaatgtggttggcttgtcttttgagggaggggcatttctaatcacactgaaatgcagtggaaacatttagtctaataaaatgatttttctcagtga

SEQ ID NO: 158126 - DNA, 680 bp, Homo sapiens
  Payload ID: 10960
  Gene Symbol: NEBL
  Gene Name: nebulette
  ENST ID: ENST00000481592
  CDS Start-End: 1-192
gtaagcatgaccccggagatagagagagtgaggcgaaaccaggagcagctgagtgcgggcatgaactgcgtgtccaggaaatttgggactgtgttgctgtaccttagctgtgtttgcttattcaagagatcttcattaagtacccaaatgtactgggcattgtcctggtcacccagacacaaagatgggtaaaatataagggagaacttcaacggggaactgcaatttctgatccaccagagctgaagagggcaaaagaaaaccagaaaaacatcagcaatgtgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtagggtccaaccagatcattcttaaaacatgctaaggaatgggcggatccagtgcacggatggcattacttcactattaatccgataactaacaaagcatggaaatgtggttggcttgtcttttgagggaggggcatttctaatcacactgaaatgcagtggaaacatttagtctaataaaatgatttttctcagtga

SEQ ID NO: 158127 - DNA, 448 bp, Homo sapiens
  Payload ID: 10960
  Gene Symbol: NEBL
  Gene Name: nebulette
  ENST ID: ENST00000473616
  CDS Start-End: 1-285
gatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtagggtccaaccagatcattcttaaaacatgctaaggaatgggcggatccagtgcacggatggcattacttcactattaatccgataactaacaaagcatggaaatgtggttggcttgtcttttgagggaggggcatttctaatcacactgaaatgcagtggaaacatttagtctaataaaatgatttttctcagtga

SEQ ID NO: 158128 - DNA, 20634 bp, Homo sapiens
  Payload ID: 10961
  Gene Symbol: NEB
  Gene Name: nebulin
  Uniprot ID: P20929
  ENST ID: ENST00000172853
  CDS Start-End: 204-20213
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 158129 - DNA, 2400 bp, Homo sapiens
  Payload ID: 10961
  Gene Symbol: NEB
  Gene Name: nebulin
  ENST ID: ENST00000397337
  CDS Start-End: 1-1979
tacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 158130 - DNA, 26202 bp, Homo sapiens
  Payload ID: 10961
  Gene Symbol: NEB
  Gene Name: nebulin
  Uniprot ID: P20929
  ENST ID: ENST00000397345
  CDS Start-End: 204-25781
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaagcctgggacaaagacaagactcagatccacataatgccagacacaccagaaattatgttggcaagaatgaacaaaatcaactacagtgagagtctgtacaaacttgctaatgaagaagcaaagaagaaaggctatgacttgcgaagcgacgccatccccatcgtggcggccaaggcctccagggacatcatcagtgactacaaatataaagatggttactgcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgcctgaccagagcgatgtcatccatgctcggcaggcctatgacctccagagtgacaatatttacaagtcagatctccagtggctgagaggcattggctgggtccccattgggtctatggatgtggtcaagtgcaagagagctaccgaaatactgagtgataacatctaccgccagcctccggacaagctgaaatttaccagtgtgactgattctctagagcaggtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacgccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggctgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcaatgcctgggagaaagagaaggctaatgtgaacgtgccagctgacactcccctgatgctgcaatccaaaatcaatgctctgcagatcagcaataaacgctatcagcaagcttgggaagatgtcaagatgactggttatgacctgcgagcagatgccattgggatccagcatgccaaggcttccagggatattgccagtgattatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcgatattgtacaaagagaacttgagcaaggggactcccctacctgtcactcctgagatggagcgagtcaaactcaatcaagaaaactttagctcggtgttgtataaagaaaacgttggaaaagggattccaatccccatcactccagagatggagagagtcaaacacaatcaagaaaactttagttcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 158131 - DNA, 20637 bp, Homo sapiens
  Payload ID: 10961
  Gene Symbol: NEB
  Gene Name: nebulin
  Uniprot ID: P20929
  ENST ID: ENST00000409198
  CDS Start-End: 204-20213
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaactc

SEQ ID NO: 158132 - DNA, 2300 bp, Homo sapiens
  Payload ID: 10961
  Gene Symbol: NEB
  Gene Name: nebulin
  ENST ID: ENST00000434685
  CDS Start-End: 1-2300
tcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttgttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttttgtacaaagaaaatgtggggaaagccaccgcaacccctgtcactcctgagatgcagagagtcaaacgcaatcaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttag

SEQ ID NO: 158133 - DNA, 766 bp, Homo sapiens
  Payload ID: 10961
  Gene Symbol: NEB
  Gene Name: nebulin
  ENST ID: ENST00000424585
  CDS Start-End: 1-766
aggaatgctactgatattgccagtcagattaagtataagcaatcagcagaaatggagaaagccaatttcacttctgtggttgatactccagagatcattcatgcccaacaagtcaagaatctttcaagccagctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgag

SEQ ID NO: 158134 - DNA, 751 bp, Homo sapiens
  Payload ID: 10961
  Gene Symbol: NEB
  Gene Name: nebulin
  ENST ID: ENST00000420924
  CDS Start-End: 1-751
cagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacc

SEQ ID NO: 158135 - DNA, 1201 bp, Homo sapiens
  Payload ID: 10961
  Gene Symbol: NEB
  Gene Name: nebulin
  ENST ID: ENST00000421461
  CDS Start-End: 1-1201
taaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcgatattgtacaaagagaacttgagcaaggggactcccctacctgtcactcctgagatggagcgagtcaaactcaatcaagaaaactttagctcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcg

SEQ ID NO: 158136 - DNA, 9443 bp, Homo sapiens
  Payload ID: 10961
  Gene Symbol: NEB
  Gene Name: nebulin
  ENST ID: ENST00000413693
  CDS Start-End: 1-9024
ggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgc

SEQ ID NO: 158137 - DNA, 26202 bp, Homo sapiens
  Payload ID: 10961
  Gene Symbol: NEB
  Gene Name: nebulin
  Uniprot ID: P20929
  ENST ID: ENST00000427231
  CDS Start-End: 204-25781
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaagcctgggacaaagacaagactcagatccacataatgccagacacaccagaaattatgttggcaagaatgaacaaaatcaactacagtgagagtctgtacaaacttgctaatgaagaagcaaagaagaaaggctatgacttgcgaagcgacgccatccccatcgtggcggccaaggcctccagggacatcatcagtgactacaaatataaagatggttactgcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgcctgaccagagcgatgtcatccatgctcggcaggcctatgacctccagagtgacaatatttacaagtcagatctccagtggctgagaggcattggctgggtccccattgggtctatggatgtggtcaagtgcaagagagctaccgaaatactgagtgataacatctaccgccagcctccggacaagctgaaatttaccagtgtgactgattctctagagcaggtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacgccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggctgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcaatgcctgggagaaagagaaggctaatgtgaacgtgccagctgacactcccctgatgctgcaatccaaaatcaatgctctgcagatcagcaataaacgctatcagcaagcttgggaagatgtcaagatgactggttatgacctgcgagcagatgccattgggatccagcatgccaaggcttccagggatattgccagtgattatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcgatattgtacaaagagaacttgagcaaggggactcccctacctgtcactcctgagatggagcgagtcaaactcaatcaagaaaactttagctcggtgttgtataaagaaaacgttggaaaagggattccaatccccatcactccagagatggagagagtcaaacacaatcaagaaaactttagttcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 158138 - DNA, 25578 bp, Homo sapiens
  Payload ID: 10961
  Gene Symbol: NEB
  Gene Name: nebulin
  Uniprot ID: P20929
  ENST ID: ENST00000603639
  CDS Start-End: 1-25578
atggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaagcctgggacaaagacaagactcagatccacataatgccagacacaccagaaattatgttggcaagaatgaacaaaatcaactacagtgagagtctgtacaaacttgctaatgaagaagcaaagaagaaaggctatgacttgcgaagcgacgccatccccatcgtggcggccaaggcctccagggacatcatcagtgactacaaatataaagatggttactgcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgcctgaccagagcgatgtcatccatgctcggcaggcctatgacctccagagtgacaatatttacaagtcagatctccagtggctgagaggcattggctgggtccccattgggtctatggatgtggtcaagtgcaagagagctaccgaaatactgagtgataacatctaccgccagcctccggacaagctgaaatttaccagtgtgactgattctctagagcaggtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacgccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggctgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcaatgcctgggagaaagagaaggctaatgtgaacgtgccagctgacactcccctgatgctgcaatccaaaatcaatgctctgcagatcagcaataaacgctatcagcaagcttgggaagatgtcaagatgactggttatgacctgcgagcagatgccattgggatccagcatgccaaggcttccagggatattgccagtgattatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcgatattgtacaaagagaacttgagcaaggggactcccctacctgtcactcctgagatggagcgagtcaaactcaatcaagaaaactttagctcggtgttgtataaagaaaacgttggaaaagggattccaatccccatcactccagagatggagagagtcaaacacaatcaagaaaactttagttcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttag

SEQ ID NO: 158139 - DNA, 25578 bp, Homo sapiens
  Payload ID: 10961
  Gene Symbol: NEB
  Gene Name: nebulin
  Uniprot ID: P20929
  ENST ID: ENST00000604864
  CDS Start-End: 1-25578
atggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaagcctgggacaaagacaagactcagatccacataatgccagacacaccagaaattatgttggcaagaatgaacaaaatcaactacagtgagagtctgtacaaacttgctaatgaagaagcaaagaagaaaggctatgacttgcgaagcgacgccatccccatcgtggcggccaaggcctccagggacatcatcagtgactacaaatataaagatggttactgcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgcctgaccagagcgatgtcatccatgctcggcaggcctatgacctccagagtgacaatatttacaagtcagatctccagtggctgagaggcattggctgggtccccattgggtctatggatgtggtcaagtgcaagagagctaccgaaatactgagtgataacatctaccgccagcctccggacaagctgaaatttaccagtgtgactgattctctagagcaggtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacgccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggctgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcaatgcctgggagaaagagaaggctaatgtgaacgtgccagctgacactcccctgatgctgcaatccaaaatcaatgctctgcagatcagcaataaacgctatcagcaagcttgggaagatgtcaagatgactggttatgacctgcgagcagatgccattgggatccagcatgccaaggcttccagggatattgccagtgattatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcgatattgtacaaagagaacttgagcaaggggactcccctacctgtcactcctgagatggagcgagtcaaactcaatcaagaaaactttagctcggtgttgtataaagaaaacgttggaaaagggattccaatccccatcactccagagatggagagagtcaaacacaatcaagaaaactttagttcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttag

SEQ ID NO: 158140 - DNA, 26307 bp, Homo sapiens
  Payload ID: 10961
  Gene Symbol: NEB
  Gene Name: nebulin
  ENST ID: ENST00000618972
  CDS Start-End: 204-25886
aggcatcacgctggcttttgcctggggttctcaggaggggagagttgggagaggctttgctgctgaggaaatttatttggtagattgaaggtttgaacgagagctacagaaacgaaagaaaaagtctgtataagccaatggtgttcgggaagaaaataaccccattgccttgagtttgtaggtgccactactactctggaaaaatggcagatgacgaagactatgaggaggtggtggagtactacacagaagaagtggtttacgaagaggtgccgggagagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccaaataaatacaaggagaagtttgagaaaacaaaaggacagccatacgccagcacaacagatactccagaacttcgcagaatcaaaaaagtacaagatcaactcagtgaggttaagtatcgaatggatggtgatgttgctaagactatatgtcacgtagatgaaaaagcaaaggatattgaacatgcaaagaaagtgtcgcagcaagtcagtaaggttttatacaagcagaactgggaagacaccaaggataagtacctgcttcctcctgatgcccctgaacttgtccaggccgttaagaacaccgccatgttcagcaagaaactgtacactgaagactgggaagcagacaaaagtttgttttacccctataatgatagcccggaactgaggagagttgcccaggcccagaaagctctcagtgatgttgcctacaaaaaaggtctcgctgaacagcaagctcaattcacgcctctggctgatcctccagatatagaatttgccaagaaagtaaccaatcaagtgagcaagcaaaaatacaaagaagactatgaaaataaaatcaaaggcaaatggagtgagacaccttgctttgaagttgcaaatgccagaatgaatgctgataacattagcacaaggaaataccaggaagattttgaaaacatgaaagaccagatctacttcatgcagaccgaaacaccagagtataaaatgaataaaaaagctggtgtggcagctagcaaggtaaaatacaaagaagactatgaaaagaataaaggaaaagcagattataatgtgcttcctgcttcagagaacccacagcttaggcagctgaaggcagcaggagatgccctaagtgacaaactatacaaggaaaactatgaaaagacaaaagcaaagagcataaattactgcgagacccccaaattcaagctcgatactgttctgcagaacttcagtagtgataaaaaatataaagattcctacttaaaagatattttgggacattatgtaggcagcttcgaggatccataccattcacactgcatgaaagtcacagctcaaaacagtgataaaaactacaaagcagaatacgaagaagacagaggcaaaggcttcttccctcagaccataactcaagaatatgaagcaattaagaaactagatcagtgtaaagaccacacctacaaagtccatccagataagacaaaattcacccaagttacagactctcctgttctgctacaagcccaagtcaattccaaacaactgagtgacttaaattacaaagcaaaacatgaaagtgaaaagttcaagtgccatatcccccctgatactcctgcttttatccagcacaaagtcaatgcctataacttgagtgataatctttataagcaagactgggagaagagcaaagccaaaaagtttgacattaaagtggatgccattcccctgctggcagccaaagccaacaccaagaacaccagcgatgtgatgtacaagaaagactatgaaaaaaacaaagggaaaatgattggagtcctcagcattaatgacgatcccaagatgctgcactccttgaaggtggccaaaaaccagagtgatagattatacaaggaaaactatgagaagacaaaggcaaagagtatgaattactgtgagaccccaaaatatcaacttgatactcagctgaagaacttcagtgaggctagatataaagacttatatgtaaaggatgttttgggacattatgtaggcagcatggaggacccatatcacacacactgcatgaaagttgcagctcaaaacagtgataaaagttacaaagcagaatatgaagaagataaaggaaaatgctatttccctcagacaataacacaagaatatgaagcaatcaagaagctggaccagtgtaaagatcatacctacaaagttcatccagataagaccaaattcacggcagtcactgattctcctgtactgttgcaagcccagctcaacacgaaacagcttagtgatctgaattacaaagcaaaacatgaaggtgagaagttcaagtgccatataccagcagatgctccacagtttatccaacacagagtcaatgcctataatctgagtgataatgtttataagcaagactgggagaagagcaaagccaagaagtttgacattaaagtggacgccattcccctgttggcagccaaagccaacaccaagaacaccagcgatgtgatgtacaagaaagactatgaaaagagcaaagggaaaatgattggagccctcagcattaatgacgatccaaagatgctgcactccttgaagacagccaaaaaccagagtgatcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgttgaatacaaagctgactacaatagctggatgaaaggttgtggctgggtgccttttgggtccttagaaatggaaaaggcaaagcgagcttcagacatcctcaatgagaaaaaatatcgccaacatccagacaccctcaagtttacctcgattgaagatgctccaattacagtacagtctaaaattaaccaggcccagaggagtgatatcgcttacaaagccaaaggagaggaaattattcacaaatacaacctgccaccagacctgccccagttcatccaggctaaagttaatgcctacaatatcagtgagaatatgtacaaagcagacttgaaagacttgagcaagaagggatatgacctgagaactgatgcgattcccatcagagctgccaaagctgccaggcaggcggcgagtgacgttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgataacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatatcttatacaaggctaaaggagaagatgtgaaacataaatacaccatgagtcctgatcttcctcagtttctccaggccaagtgcaatgcttacaatataagtgacgtctgttataaacgggattggtatgacttaatagccaagggcaacaatgtgctgggcgatgctattcccatcactgcagccaaggcatcgagaaacattgccagtgattataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacagccattgcatcattacacatacctacctgacgccatgagtcttgagcatacgaggaatgtcaatcaaattcagagtgataatgtgtataaagacgagtataacagcttcttgaagggcatcggatggatccctattggttccctggaggtggagaaggtcaagaaagcaggcgatgcattaaatgagaggaagtatcgacagcacccagataccgtcaagttcacaagtgtgcctgattccatgggcatggtgttggctcagcataacacaaagcagctaagtgatttgaactacaaggtagagggagagaaactgaagcacaagtatactattgaccctgaattgcctcagtttattcaagccaaagtcaacgccctcaacatgagtgatgctcattataaagcagattggaagaaaaccattgccaagggctatgatttgagaccagatgccatcccaattgttgctgcaaaaagttcaaggaatattgctagtgattgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgataatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttacgccatggacacaatggaacaggcacttaacaagagtaacaaactgaacatggacaagaggctctacactgaaaaatggaacaaggacaagaccaccattcatgtcatgcctgacacaccggatattttactctccagagtaaaccaaatcaccatgagtgataaactgtacaaagctggctgggaagaggaaaagaagaaaggatatgacctgaggcctgatgccattgcaataaaggctgcaagagcctctagagacattgccagtgattacaaatacaagaaagcctatgaacaagccaaagggaaacacattggcttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttcctgatgccatgagctttgaattggccaaaaatatgatgcagattcaaagtgataatcagtacaaggctgactatgctgacttcatgaagggcattggatggctccctctgggctccctggaagcagagaaaaacaagaaagccatggagattattagtgaaaagaagtaccgccagcacccagacactttgaagtattccacactcatggactcgatgaacatggttttggcccagaataatgcaaaaattatgaacgaacatctctacaaacaagcatgggaggctgacaaaaccaaagtccacatcatgcctgatatcccccagattattttggcaaaggcaaatgcaattaatatgagtgataaactctacaaactttccttggaagagtctaaaaagaaaggctatgatctcagacctgatgcaattcctatcaaagctgccaaggcttccagagatattgcaagtgattataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgataatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaagcatttatacaccattgattggaataaagataagaccaagattcatgtgatgcctgatacaccagatattttacaagccaagcagaatcaaacactgtatagtcagaaactctataaacttggatgggaagaagctttgaagaaaggctatgatctcccagttgatgcaatttctgtacagctagctaaagcttcaagagacattgctagtgattataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgagaatctatataaatctgaccttgagtggctgagaggcataggatggagtcccttgggttctttagaggcagaaaagaacaagcgggcttcggaaatcatcagtgagaagaaatatcgtcagcctccagacagaaacaagttcaccagcattcctgatgccatggatatagttctggcaaagacaaatgccaaaaataggagtgatagactttatagagaagcttgggacaaagacaagactcagatccacatcatgcctgatacacctgacattgttctggctaaagcaaacttaatcaacacaagtgataaactctaccgaatgggttatgaggagctgaagagaaaaggttacgatcttcctgttgatgccataccaatcaaagcagcaaaagcctcccgggaaattgccagtgaatacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaagaagtgccagaccttagtcagcgacgtggactacaagaactacctgcaccagtggacatgcctgcccgaccagagcgatgtcatccatgctcggcaggcctatgacctccagagcgataatttgtacaagtcagaccttcagtggctaaaaggcattggctggatgactagtggttctctcgaggatgagaaaaataaacgagccacccagattttgagtgaccatgtttaccgtcagcacccagatcaatttaagttttccagccttatggattccataccaatggttttggcaaaaaacaatgctattaccatgaatcatcgcctctatacagaagcttgggataaagataaaaccactgtccacattatgccagatacccctgaagttttattagctaaacaaaacaaagtaaattacagtgagaaattgtataagcttggcctagaagaagccaagaggaaaggttatgacatgcgggtagatgccattcctatcaaggcagccaaggcctccagagatattgcaagtgaattcaagtacaaagaaggctatcgtaagcagctcggccaccacattggtgcccgagctatacgtgatgaccccaagatgatgtggtccatgcacgtggccaagatccagagtgacagggagtacaagaaggactttgagaagtggaagaccaagttcagcagcccagtggacatgctgggggtggtgctggccaagaagtgccagaccttagtcagcgatgtggactacaagaactacctgcaccagtggacatgcctgcccgaccagagcgacgtcatccatgctcggcaggcctatgacctccagagcgataatatgtacaagtctgatctccagtggatgagaggcattggctgggtgtccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaagcgtttatacacagaagcctgggacaaagacaagactcagatccacataatgccagacacaccagaaattatgttggcaagaatgaacaaaatcaactacagtgagagtctgtacaaacttgctaatgaagaagcaaagaagaaaggctatgacttgcgaagcgacgccatccccatcgtggcggccaaggcctccagggacatcatcagtgactacaaatataaagatggttactgcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgcctgaccagagcgatgtcatccatgctcggcaggcctatgacctccagagtgacaatatttacaagtcagatctccagtggctgagaggcattggctgggtccccattgggtctatggatgtggtcaagtgcaagagagctaccgaaatactgagtgataacatctaccgccagcctccggacaagctgaaatttaccagtgtgactgattctctagagcaggtgctggccaagaacaatgctctcaacatgaataagcgtttatacacagaggcctgggacaaagacaagactcaaattcacataatgcctgatacaccagagattatgttggcaaggcagaacaaaatcaactacagtgagactctatacaaacttgccaatgaagaagcaaaaaagaaaggctacgacttgcgaagtgacgccatccccatcgtggctgccaaggcctccagggacgttatcagtgattacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgataacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaagcgcttatacacagaagcctgggacaaagacaagacccaagtccatattatgcctgatacacctgaaatcatgttggcaagacaaaataaaataaattatagtgagagcctctatcgtcaggccatggaagaagccaagaaagaaggctatgacttgagaagtgatgccattcccattgtggctgccaaggcctctcgggatattgccagtgattacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaagacaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataagcgcttatatactgaagcctgggacaatgacaagaaaactattcatgtcatgcctgatacaccagaaatcatgttagccaaactcaaccgaataaactacagtgataaactctataaacttgctttggaagagtccaagaaggaaggctatgacttgcgtctggatgccattccaatccaagcagccaaggcttcaagagatattgctagtgattacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgctatttacaaatctgatcttgagtggctgagaggcataggatgggttcccattggctctgtagaggtcgagaaagtgaagagagctggagaaatcctgagtgacaggaagtatcgccagcctgcagaccagctcaaattcacatgcattaccgacactccggaaattgtcctagcaaagaataatgccctgacaatgagcaagcatttatacacagaagcttgggatgctgacaaaacctccatccacgtgatgccagacaccccagatatcctgctggccaagagtaattctgccaatatcagccaaaaactttacaccaagggatgggatgaatcaaagatgaaggactatgatctgagagcagatgctatttccatcaaaagtgccaaggcctccagggacatcgccagtgactacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacgccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggctgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcaatgcctgggagaaagagaaggctaatgtgaacgtgccagctgacactcccctgatgctgcaatccaaaatcaatgctctgcagatcagcaataaacgctatcagcaagcttgggaagatgtcaagatgactggttatgacctgcgagcagatgccattgggatccagcatgccaaggcttccagggatattgccagtgattatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccactggtcttgctttcccgaccagaatgatgtgatccaagccaggaaagcctacgacctacagagcgacagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgagaaactgtatcaggaagcctggaataaagataaaagcaacatcaccattccttctgatactccggagatgctgcaggcccacatcaatgccttgcaaatcagcaataaactctaccaaaaagactggaatgacaccaagcagaaaggctatgacataagggcagatgccattgaaatcaagcacgccaaggcctccagagaaattgccagtgagtacaaatacaaagaaggttaccgtaagcaactgggccaccacatgggtttccgcaccctacaagatgaccccaagtcagtatgggctatacatgctgccaagatccagagtgacagagaatataagaaagcttatgagaagtctaaaggaattcacaacacaccgttggacatgatgtcaattgttcaagccaagaaatgccaggtcctggttagcgacattgattatcgcaattatctgcaccagtggacgtgtctgccagatcagaacgatgtgatccaggccaagaaagcctacgacctgcagagcgataacttgtacaagtcagacctggaatggctgaagggtattggatggttgccagagggttctgtggaagtgatgagagtgaagaatgcccagaatctcttgaatgaaaggctgtatcgtataaagcctgaggccctcaaattcaccagcattgttgacaccccggaagtaatccaggcaaagatcaatgctgtacagatcagtgagccattgtatcgcgatgcctgggagaaagagaaggctaatgtgaacgtgccagctgacactcccctgatgctgcaatccaaaatcaatgccctgcagatcagcaataaacgctatcagcaagcttgggaagatgtcaagatgactggttatgacctgcgagcagatgccattgggatccagcatgccaaggcttccagggatattgccagtgactatctgtacaaaactgcttatgagaaacagaaaggccattacattggctgtcgcagcgccaaggaagaccctaaactggtttgggcagcaaatgtgttgaagatgcagaatgacaggctgtacaaaaaggcctacaacgaccacaaagccaagatctccatccctgtggacatggtgtccatcagcgctgccaaagaaggtcaggcactggcaagtgatgtggactatcgccattacctgcaccgctggtcttgctttcccgaccagaatgatgtgatccaagccaggaaagcctacgacctacagagcgacgccctctacaaggctgacttggagtggttgcgtggcattggctggatgccccaagggtctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattccaaagtacagagaggtttgggacaaggataaaacttcaatacacataatgccagatactccagaaattaatctcgctagagcaaatgctcttaatgtgagcaataaactttaccgtgagggctgggatgaaatgaaggcgggctgtgatgtccggctggatgccatccccatccaggctgccaaggcctccagggagattgccagtgactataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctgcactctaaaaattcccaggctctggtcagtgacatggattaccgcaattacctgcaccagtggacctgcatgcccgaccagaacgatgtgattcaggccaagaaggcctacgaactgcagagcgataatgtttacaaggctgacttggaatggttgcgtggaattgggtggatgccaaatgactccgtgtccgtcaatcatgccaaacatgccgcggacatcttcagtgagaaaaaatatcgcacaaaaatagaaactctcaactttacgcctgtggatgacagagttgattatgtgacagcgaaacaaagtggcgagatcctcgatgatattaaataccggaaagactggaatgccaccaaatcaaagtacaccctcacagaaacccccctgctgcacactgcccaggaggctgctaggatactggaccagtatctctacaaggaaggctgggagagacaaaaagccacaggttacattttgcctccagatgctgtgccatttgttcatgcccatcactgcaatgacgttcagagtgagctgaaatacaaagctgaacatgtgaagcaaaaaggtcattatgttggtgtcccgacgatgagagatgatcctaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgataatgtctacagagctgacctggagtggctccgaggcattggctggatcccactggattctgtggaccatgtaagggttactaagaaccaggaaatgatgagtcagatcaaatataagaaaaatgcccttgaaaactatcctaactttagaagtgtggtggatcctccagagattgttttagccaagattaattctgtcaatcaaagtgatgtaaaatataaagaaacatttaataaagcaaagggcaaatatacgttttcaccagatacaccacatatctcccactccaaagacatgggaaaactctacagtactatactgtataaaggggcgtgggagggcaccaaggcctatggctacaccctggatgagcgctacattcccattgttggagccaagcatgctgatctggtgaacagtgagcttaaatacaaagagacatatgagaagcagaaaggtcactacctggctggaaaagtgatcggtgaattccctggtgtggttcactgtctggatttccaaaagatgaggagtgcgttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgataatgtgtataaagatgacctgaattggttgaaaggcattggttgctacgtttgggatacaccccaaatcctccatgccaagaaatcatacgaccttcagagtcagctacaatatacagcagcaggtaaagaaaatctacaaaactataatctggtcacagacacgcccctctatgtgactgctgttcagagtggcattaatgccagtgaggtaaaatataaagaaaattatcatcagattaaggacaaatacacaacagttctagaaacagtggattatgacagaaccagaaacctgaagaatctttacagcagtaacctgtacaaggaggcctgggatagagtgaaagccaccagctacatcctgccttccagcaccttgtccctgacacacgccaagaaccagaagcatctggccagccatatcaaatatcgggaagaatatgaaaagttcaaagctctttatacgttaccaagaagtgttgacgatgatccgaacacagcacggtgcctccgagttggcaagcttaacatcgatcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatattgtatacaaggatgacctcaactggctgaaaggcattggttgctacgtctgggacactcctgaaatcctccatgccaagcatgcttatgatctacgtgatgatatcaagtataaagctcacatgttgaaaacaaggaatgactacaagcttgtcacagatacaccagtctacgtgcaggctgtcaaaagtgggaaacagctaagtgacgctgtctaccactatgactatgtgcacagtgtcagaggcaaagtggctccaactaccaaaaccgtggatctggaccgggcccttcatgcatacaagctccagagttcgaatctatacaaaaccagcctgcgcaccctgcccactggatatagacttccaggtgacactcctcacttcaaacacatcaaggacacccgttacatgagcagttatttcaagtacaaagaagcctatgaacacaccaaggcatatgggtatacacttggccccaaagatgttccatttgtccacgtccggagagtcaacaatgttaccagcgagagactgtatcgggaattgtaccacaaactgaaagacaagatccatacaactcccgatacccctgagatccgccaagtcaagaagacacaagaggctgtcagtgagttgatctacaaatcagacttcttcaagatgcagggccacatgatctctctgccatacacaccccaagtgatccattgccgctatgtgggagacatcaccagtgatattaaatacaaagaggacttgcaggtcctgaagggatttggctgcttcctgtatgacactcctgacatggtccgctcccggcacctgcggaagctctggtctaattacctatacactgataaggcaaggaagatgcgagacaaatacaaagtggtgcttgacactccagaatacagaaaagtgcaagaactgaagacacatctgagtgagctggtctacagagctgcaggcaagaagcagaagtcaatctttacttcagttcctgatactcctgatcttttaagagccaagcgagggcagaagcttcagagtcagtatctgtatgttgaacttgccaccaaagagagaccccatcatcacgctggaaaccagaccacagccttgaagcatgctaaagacgtgaaggacatggtcagtgagaaaaagtacaagattcaatatgaaaagatgaaagacaagtacactccggttccagatacgccaatcctcatcagagccaagagggcttactggaatgccagtgatctacgctacaaagaaacatttcaaaagaccaaagggaaataccacacggtgaaagatgccctagacattgtctatcatcgcaaagtcacagatgacatcagtaaaataaaatacaaggagaactacatgagccagttgggtatctggaggtccattcctgatcgtccagagcatttccaccaccgagcagtcactgacacagtcagtgatgtaaaatataaagaagacttgacttggcttaaaggcattggttgctatgcctatgatacccctgatttcactctggctgaaaagaacaagactctctacagcaagtataagtataaagaagtatttgaaaggacaaagtcagatttcaagtatgttgccgactctccgatcaataggcatttcaagtatgcaactcaattgatgaatgagaaaaaatacagagctgattatgagcagcggaaagataaataccacctggtagtcgatgagcctagacatctgctggctaagaccgcaggcgaccagatcagtcagagaaaatataaatctagtgccaagatgtttctgcaacatggatgtaatgaaattctgcgtccagatatgttgactgctctctacaattcgcatatgtggagccagatcaaatacaggaaaaactatgaaaaatcaaaggacaaatttacctcaattgtggatactccagaacacctgcgtactacaaaagtcaacaaacaaatcagcgatatcctttataaattggaatacaacaaggccaaacccagaggctacaccacaatccacgacacacccatgttgctgcatgtccgcaaggttaaagatgaagtcagtgatctgaaatacaaagaagtataccaaagaaataaatccaactgcaccattgagccagatgctgttcatatcaaagcagccaaggacgcctacaaagtcaacaccaatctggactataagaaacagtacgaagccaacaaagcccactggaagtggactcctgaccgaccggacttcctccaggctgccaagtcatccctgcagcaaagcgattttgaatataagctggaccgggagttcctcaagggttgcaagctttctgtcactgatgacaaaaacacggtgctcgccctcaggaatactttaatagaaagtgatctgaaatacaaagagaaacatgtcaaggaaagaggaacctgccatgccgtacctgacacgcctcagatcctgctggcgaagactgtcagcaacctggtgtctgagaacaagtacaaggaccatgtcaagaagcacttggcacagggctcatacacaacactaccagagacccgggacactgttcacgtcaaggaagtgaccaagcatgtcagtgatacaaattacaaaaagaagtttgtcaaggagaaaggaaaatccaactactccatcatgctggagccaccagaggtgaaacatgctatggaagtggccaagaagcaaagtgatgtcgcttacagaaaagatgccaaagagaacctgcattacaccacagtggctgatcgaccagacatcaagaaggccacacaggcagccaaacaggccagtgaggtggagtacagagccaagcaccgcaaggaaggcagccatggcttaagcatgctcggtcgcccagacatagaaatggccaagaaggcagccaagctgagcagccaggttaaataccgagaaaatttcgataaagaaaagggcaagacaccaaaatacaatccaaaagacagccagctctacaaagtcatgaaagatgctaataatcttgcaagtgaggttaaatacaaggctgacctgaagaaacttcacaaacccgtgactgacatgaaggagtctctgatcatgaatcatgtcctgaatacaagccaacttgccagttcttaccagtacaagaagaagtatgagaagagtaaaggccactaccacaccatacccgataatctggagcagcttcacctaaaagaggccacagaattacagagtatagtgaaatacaaagaaaagtatgaaaaggaacgaggaaaacccatgctggactttgaaacaccaacgtacatcactgccaaagagtctcagcagatgcagagtgggaaagaatataggaaagattatgaagagtccattaaaggcagaaacctgactggcctggaggtcacgccagctttgttacatgtcaaatatgcaactaaaatagcaagcgagaaagagtacaggaaagatctagaggaaagcatccgtgggaagggcctcactgaaatggaagatacacctgacatgctaagagcaaagaatgccactcaaatcctcaatgagaaagaatataagcgagacctggaactggaagtcaaaggaagaggcctgaatgccatggccaatgaaactccggattttatgagggccaggaatgctactgatattgccagtcagattaagtataagcaatcagcagaaatggagaaagccaatttcacttctgtggttgatactccagagatcattcatgcccaacaagtcaagaatctttcaagccagaaaaagtacaaggaagatgctgagaagtccatgtcgtattatgagactgttttggacaccccagagatacagagagtccgggagaaccaaaagaacttcagccttctccaataccagtgtgaccttaaaaacagtaaaggaaaaattacagttgttcaagacacgccagaaatactgcgtgtaaaagaaaatcagaagaatttcagctcggttttatataaagaggatgtctcaccaggaacggctatcggaaagacacctgagatgatgagagtgaaacaaacacaggaccacattagctcggtgaagtataaggaagcaataggacaaggaactccaatccctgacctgcctgaagtgaaacgtgtgaaggagacgcagaagcacattagctcggttatgtacaaagaaaacttgggaacaggcattccaaccactgtgactccagagattgagagagtcaaacgcaatcaagagaactttagctcggttttgtacaaagaaaatttggggaaaggaatcccaacacctatcactccagagatggagagagtcaaacgcaatcaagagaactttagctcgatattgtacaaagagaacttgagcaaggggactcccctacctgtcactcctgagatggagcgagtcaaactcaatcaagaaaactttagctcggtgttgtataaagaaaacgttggaaaagggattccaatccccatcactccagagatggagagagtcaaacacaatcaagaaaactttagttcggtgctatacaaagaaaacctggggacaggaattccaatccccatcactcctgagatgcagagagtcaaacacaatcaagaaaaccttagctcggtgttatacaaagaaaacatgggcaagggaacccctttacctgtcactcccgagatggaaagagtcaaacacaatcaagaaaatattagctcggtgttatacaaagaaaacatgggcaagggaacccctctacctgtcactcctgagatggagagagtcaaacacaatcaagaaaatattagctcggtgttatacaaagaaaacatgggcaagggaactcctttagctgtcactcccgagatggagcgagtcaaacacaatcaagaaaatattagctcggttttgtacaaagaaaatgtggggaaagccaccgcaacccctgtcactcctgagatgcagagagtcaaacgcaatcaagaaaacattagctcggtgttatacaaagagaacctggggaaagcaacccccacaccctttactcctgagatggaaagagtgaaacgcaatcaagaaaactttagctcggtattgtacaaagagaacatgagaaaagcaactccgacacctgttactccagagatggagagagctaagcgcaaccaagaaaacattagctcggttctttattctgatagtttccggaaacaaatacaaggcaaagctgcctatgtattggatacccccgagatgagacgggtgagggagacccaacggcacatctcaacggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtttacgtgtctggcgtactaatcctggttcggtttttgactatgatccagcagaagacaacatccagtcccgaagcttacacatgattaatgtccaagctcagcgccggagccgggagcagtcacgatctgccagtgcactaagcatcagtgggggtgaggagaagtctgagcattcagaagcaccagaccaccacctttcgacttacagcgacgggggtgtctttgcagtctcaacagcttacaaacatgcaaaaaccacagagctcccacaacaacgatcatcttcagttgctacccaacagacaacggtatcttccatcccatctcatccatctactgctggaaaaatcttccgtgccatgtatgactatatggctgctgatgcagatgaggtgtccttcaaggatggagatgccatcataaatgttcaagcaattgatgaaggctggatgtatggcactgtgcagaggactggcaggaccggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgcctagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaa

SEQ ID NO: 158141 - DNA, 5580 bp, Homo sapiens
  Payload ID: 10962
  Gene Symbol: NRAP
  Gene Name: nebulin-related anchoring protein
  Uniprot ID: Q86VF7
  ENST ID: ENST00000359988
  CDS Start-End: 246-5438
agacacatgcgtgctgagtgagtggccaaaatagccccttgagtaagtggcagctttaaaaaccatccaactgctgacttcaaactagaaggtcagcaaaggaaagtggaagttggattctgaaagatcgaggtgcccacaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcactgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggtggatactcctgagctgctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaagctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccaatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacctgaggctgagctgtgccaagaaagctcacaaattgcagagtgagaatttgtaccggtcagacctgaactttatgcgaggtgttgcatgtgtcattccaggcacgttagagattgaagggaggaagaaagcatcggaactcatcagtgagagtaaatatcggcagcatccccactcattcaagtacacagctgtgacagacactcccaacctccttcatgcgaaattcagcaaccagataacgaatgagcgcctctataaagcagctggagaggatgcaagacacgagtatacaatgaccctgggtctgcccgagttcatccgagcaaaaacgaatgcagccaacctgagtgacgcaagatacaaagagtcctggcgtaatcttcgtgctcaaggctacaagctgacaatagaagcgctccccttccaggctgcccgggcctctggagatatagccagtgattttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaa

SEQ ID NO: 158142 - DNA, 5426 bp, Homo sapiens
  Payload ID: 10962
  Gene Symbol: NRAP
  Gene Name: nebulin-related anchoring protein
  Uniprot ID: Q86VF7
  ENST ID: ENST00000360478
  CDS Start-End: 189-5276
aaaaaccatccaactgctgacttcaaactagaaggtcagcaaaggaaagtggaagttggattctgaaagatcgaggtgcccacaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcactgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggtggatactcctgagctgctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgagaataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaagctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccaatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacctgaggctgagctgtgccaagaaagctcacaaattgcagagtgagaatttgtaccggtcagacctgaactttatgcgaggtgttgcatgtgtcattccaggcacgttagagattgaagggaggaagaaagcatcggaactcatcagtgagagtaaatatcggcagcatccccactcattcaagtacacagctgtgacagacactcccaacctccttcatgcgaaattcagcaaccagataacgaatgagcgcctctataaagcagctggagaggatgcaagacacgagtatacaatgaccctgggtctgcccgagttcatccgagcaaaaacgaatgcagccaacctgagtgacgcaagatacaaagagtcctggcgtaatcttcgtgctcaaggctacaagctgacaatagaagcgctccccttccaggctgcccgggcctctggagatatagccagtgattttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatgg

SEQ ID NO: 158143 - DNA, 5534 bp, Homo sapiens
  Payload ID: 10962
  Gene Symbol: NRAP
  Gene Name: nebulin-related anchoring protein
  ENST ID: ENST00000369358
  CDS Start-End: 189-5384
aaaaaccatccaactgctgacttcaaactagaaggtcagcaaaggaaagtggaagttggattctgaaagatcgaggtgcccacaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcactgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggtggatactcctgagctgctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgaggtggagtataagaaggatctggaaagtagtagaggtcacagtatcaactactgtgaaacacctcaattcaggaacgtgagcaagatctcaaaatttaccagtgataataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaagctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccaatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacctgaggctgagctgtgccaagaaagctcacaaattgcagagtgagaatttgtaccggtcagacctgaactttatgcgaggtgttgcatgtgtcattccaggcacgttagagattgaagggaggaagaaagcatcggaactcatcagtgagagtaaatatcggcagcatccccactcattcaagtacacagctgtgacagacactcccaacctccttcatgcgaaattcagcaaccagataacgaatgagcgcctctataaagcagctggagaggatgcaagacacgagtatacaatgaccctgggtctgcccgagttcatccgagcaaaaacgaatgcagccaacctgagtgacgcaagatacaaagagtcctggcgtaatcttcgtgctcaaggctacaagctgacaatagaagcgctccccttccaggctgcccgggcctctggagatatagccagtgattttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccagcggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatgg

SEQ ID NO: 158144 - DNA, 5535 bp, Homo sapiens
  Payload ID: 10962
  Gene Symbol: NRAP
  Gene Name: nebulin-related anchoring protein
  Uniprot ID: Q86VF7
  ENST ID: ENST00000369360
  CDS Start-End: 165-5276
aaactagaaggtcagcaaaggaaagtggaagttggattctgaaagatcgaggtgcccacaggaattttatggtcgtcggattttgaagacttgaactagactgggggttctccttgcatttcttgcctgttgcctatctttgtcctctctcttccggcttcgagatgaatgtgcagccctgttctaggtgtgggtatggggtttatcctgccgagaagatcagctgtatagatcagatatggcataaagcctgttttcactgtgaagtttgcaagatgatgctgtctgttaataactttgtgagtcaccagaaaaagccgtactgtcacgcccataaccctaagaacaacactttcaccagtgtctatcacactccattaaatctaaatgtgaggacatttccagaggccatcagtgggatccatgaccaagaagatggtgaacagtgtaaatcagtttttcactgggacatgaaatccaaggataaggaaggtgcacctaacaggcagccactggcaaatgagagagcctattggactggatatggggaagggaatgcttggtgcccaggagctctgccagaccccgaaattgtaaggatggttgaggctcgaaagtctcttggtgaggaatatacagaagactatgagcaacccaggggcaaggggagctttccagccatgatcacacctgcttatcaaagggccaagaaagccaaccagctggccagccaagtggagtataagagagggcatgatgaacgcatctccaggttctccacggtggtggatactcctgagctgctacggagcaaggctggggcacagcttcaaagtgatgtgagatacacagaggactatgaacaacaaagagggaaaggcagtttccctgcgatgatcacacccgcctatcagatagccaaaagagccaatgagctggcaagtgatgtgaggtaccatcaacaatatcaaaaagaaatgaggggaatggctggtccagccattggagctgagggcatcttgacaagggaatgtgcagaccaatatggccagggttacccggaggagtatgaggagcacaggggaaagggcagcttcccagctatgatcactccagcatatcagaacgccaagaaagctcacgaactcgctagtgacataaaatacaggcaggacttcaataagatgaaaggcgctgcacattatcactcgcttccagctcaagacaacttggttctcaaacaggctcagagcgtaaacaaactcgtgagtgagaataaatataaagaaaactaccagaaccacatgagaggccgctatgaaggagttggtatggacagacgcactctgcatgctatgaaagttggcagcctggcaagcaacgttgcctacaaagctgattataaacatgatattgtcgactacaactacccagccactctcacgccttcctatcaaacagctatgaaactggtgcccttgaaagatgccaattataggcagagcatcgacaagttgaagtacagctcggtgactgacaccccacagattgttcaagccaaaatcaatgcccagcagctgagtcatgtgaattaccgtgctgactatgagaaaaataagttgaattacacattgccccaggatgttcctcagctggtgaaggccaaaaccaatgccaaactcttcagtgaggttaagtataaagaaggctgggagaagacaaaggggaaaggatttgagatgaagctggatgccatgtctctgctggccgccaaagcctctggggagcttgctagcaatgtacaccttcttctttctctcaagattaaatataaagaagaatatgaaaagacaaaaggcaaagccatgggaacagccgactctaggcttctgcactccctgcagattgctaagatgagcagtgaggttgaatataagaaaggctttgaagagagtaagacccggtttcacctgcccatggatatggtaaacatcaggcatgctaagaaggcccaaactctcgccagtgacctggactacaggaagaaactgcatgaatacactgtgctgcctgaagatatgaagactcagtgggccaagaaggcctatgggctccagagcgagctgcagtacaaggctgacctggcatggatgaagggagttgggtggctgacagaggggagtctcaacttggaacaagccaagaaggctggacagctggtcagcgagaaaaactaccggcagagggtcgatgagctgaagttcaccagcgtgaccgacagctcccagatggagcacgccaagaagagccaggagctacagagcggggtggcctacaaggcaggaaatgagcagtctgtccatcagtataccatcagcaaagacgagcctctcttcctgcaggcccgagccaatgctgcaaatctcagcgagaaactgtataagagcagctgggaaaaccagaaagcaaaagggtttgagctgcgtcttgattccttgaccttcctggcagccaaagccaagagggacctggctagcgaggtgaagtacaaggaggattatgagagatccagagggaagctcattggggcaaaagatgtacagggagattcgcaaatgagccactcactgcaaatgtccaagctgcagagtgagctggagtacaagaagggattcgaggacaccaaatcccaatgccacgtctccctggacatggtccacctcgtgcatgcccgcaaagctcagcatttagccacagacgtaggctacaagacagcggaacatcactttacggctttgcccacagacatgaaggtggaatgggccaagaaggcttatggcttacagagtgataaccaatacagggcagatgtgaagtggatgaaaggcatgggctgggtcgccaccgggtcattaaatgtggagcaggcgaagaaggcaggagaactcattagcgagaagaagtaccgtcagcatccagatgctttgaagtttaccagtattaaagacactccggagatggtccaggccagaattagttatacccaagcagtggatagattatacagggaacaaggagaaaacataaagcatcattacacaccgactgctgacctccctgaagtcctgctggccaagctgaatgccatgaatatcagtgagacgcgttataaggaatcctggagcaaacttcgagatggtggctataaactgaggttggatgcccttccattccaagcagcaaaggcttctggtgaaatcataagtgattacaaatacaaagaggcatttgagaaaatgaaaggacagatgcttggttcccggagcttggaagatgatatcagccttgcacattcagtgtatgcgacctcactgcagagtgatgtgaattacaagaaaggctttgaacactcaaaggcgcagttccatctgccgttggacatggccgccctggtgcatgccaagaaggctcagaccctggccagcaatcaggactacaaacatccactgccccagtacacttccttggcagaagacctgaggctgagctgtgccaagaaagctcacaaattgcagagtgagaatttgtaccggtcagacctgaactttatgcgaggtgttgcatgtgtcattccaggcacgttagagattgaagggaggaagaaagcatcggaactcatcagtgagagtaaatatcggcagcatccccactcattcaagtacacagctgtgacagacactcccaacctccttcatgcgaaattcagcaaccagataacgaatgagcgcctctataaagcagctggagaggatgcaagacacgagtatacaatgaccctgggtctgcccgagttcatccgagcaaaaacgaatgcagccaacctgagtgacgcaagatacaaagagtcctggcgtaatcttcgtgctcaaggctacaagctgacaatagaagcgctccccttccaggctgcccgggcctctggagatatagccagtgattttctctacagacatgactttgtgaaggagcgagggaaactcatagggccccagagtgtaagagacgacccccggatccagcactgccggcgcatgggccagctgcagagcgagcttcagtacaggaggggggcgaccagcagccaagcccagttccatctgcccatggacatggtgcacctggtccatgccaagaatgcccaggctctggccagcgaccacgactacaggacacagtatcacaagttcacagcactgcccgaggacctgaagatggcctgggccaagaaagcccatgccctgcagagtgagttgcgctacaagtcagacctgatcggcatgaagggcataggatggctggcgctgagatccccacagatggagagtgcaaagaaggctggagaactcatcagcgagaccaagtaccgtaaaaaaccagacagtatcaagttcaccacagtggttgactccccagacctggttcatgccaagaacagctatatgcactgcaatgagcgcatgtatagatctggagatgcagaatccctgcacagatacaccctgatccccgaccatcccgatttcacccgagctcgcctcaatgcgctgcatctgagtgacaaagtctacagaaactcctgggagcagacccgggctggcagttatgacttcaggctggatgccatccccttccagactgcccgggcatctagggagatcgccagtgatttccggtacaaagaggctttcctgcgggaccgaggcctgcagatcgggtaccgcagtgtcgacgatgacccaaggatgaagcatttcctcaacgttggcaggctccagagtgacaatgagtacaagaaggactttgccaagagtcggtcccagtttcacagcagcacagaccagcccggcctccttcaggccaagaggagccagcagctggccagtgatgtgcactacaggcagcccctgccccagcccacctgcgacccggagcagctgggcctcaggcatgctcagaaggcccaccagctgcagagtgatgtcaagtataaatcagacttgaacctgaccagaggtgttggctggacccctcctggctcctacaaagtggaaatggctcggcgggctgcggaactggccaacgcaaggggcctgggtctccagggagcttaccggggggcagaagcagtggaggctggagatcatcagagtggggaggtgaacccagatgccactgagattctgcacgtcaaaaagaagaaggccctgctgttgtgagccatgtccaccctgattcctgagaggccagagaggaagtttgttcaccagagacaggcttcagatggctttgatttcggcaagctggaatggcccaccagcccatcccagatcttcctttattaaaataataactctgaaagcagatggagaatgttgtatttgtggtcctctctgatacctagacgtggatggctgattctgttgagtgcctcgagtgtctgggctgaggaataaagatgtgatggtggttcccgct

SEQ ID NO: 158145 - DNA, 2587 bp, Homo sapiens
  Payload ID: 10963
  Gene Symbol: NECAP1
  Gene Name: NECAP endocytosis associated 1
  Uniprot ID: Q8NC96
  ENST ID: ENST00000339754
  CDS Start-End: 79-906
gcgctttgcatctccgcctcccgtgctccgcctccggtcttacgtttcgcccccggcagcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgttaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaagtg

SEQ ID NO: 158146 - DNA, 2446 bp, Homo sapiens
  Payload ID: 10963
  Gene Symbol: NECAP1
  Gene Name: NECAP endocytosis associated 1
  Uniprot ID: Q8NC96
  ENST ID: ENST00000450991
  CDS Start-End: 22-330
agcgccgacagcggacccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactggtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctccagctctgttccaaaccaggcaccacagccatccaactgggtccagttctgaatggcattggcaggacattaaggacagacttgaggaataaaaatgaccttgagggcaccaatctgtgagggaagttaggaacccatttcctccccagaaccagaatgactggacaatctttttcatagcttctccatcacattcaagctggtttatgtcactcccctgtgttgttacttgtacagccaagaaagtatctgttatctcctgcgtagtaccaaggtaggggactagtggatcttatcatagttttggctgactatgcagggcttaaaaggccagcgtctgtttgagggggaatgacctctaacatctgtaaaatttgtctcatcttttaatttctttaacttatttcaaaatcatctcatgacccttgtgtgcctctttgtgaagccctatttagcaatttcaggggagtcaaaaaccttgcaacttccttctccactaacccaggactaaaaatggacaggctgacctcagtgtttacaaattcagaattttgataggggtagatatggagaaagacctatttcctgggtctctgctgtgtagtctccttcaggcttattgtgctcagtgaacatccagtgctgggtgcagctccatcaccctcttgtgtgtttacatgtctctttctatgataagagggttgtgttggtggcacctccactactcttttctgtttgttgagtttgaattgtgttaacatctttgatcagtgggtgtatctgtaatgaaggaggttcaagaggctgtgctttccaagtgatagtctataggagtgtttaatttcttgcagctccatctggttgctgcatttgaagcatggcattaatttgtatttgccctgttctttgacctaaagttgaagggtttagagtttttaacctgatctgtagagcagagaggttgaaagcacttaactcttgtttagtatcctcattgccttgctgcctgggtatctggcccctttccataaacatttcttttcagttcatgtagttctttaatagaaagctgctattatgtatattgtcatttgtgaaggaagttggagagtcacagctttactgtgacaggttttgcccaaggctttgatacctgtcacccagggtatcttaaaagcaagttgttctcccactactttcctttccctctgccctgccattcctattacaatgctgtgaaaaaagttctgcttcttaggtgaatgggtactttctattttgtttctaaacgagcaattttgaggatgaaatgggaagatatcattgcttcctttttgcacctattgggtatgtacactctggccgaagggagtccttatgtttagtttcaaaatatattactttcctggattctcttcttcactttttctgactttgggtccattttcttttcattgcctccttttccaggcagctctattcttgcagagccatagcaggacatgttaaaattccaatagaaaacactaaaaggaaagtctgtggaatcactagtgactaaatactgggaacctattttctcaatcttcctccatgttgtgttctttgtattcttgagatgataatatattatgtatttgaattcctgaaaaatggaaaatgtttaagatatatgtatataaagtgtatgctgtattggtgcaataatggtaattaaaaatatgaaaaaag

SEQ ID NO: 158147 - DNA, 863 bp, Homo sapiens
  Payload ID: 10963
  Gene Symbol: NECAP1
  Gene Name: NECAP endocytosis associated 1
  ENST ID: ENST00000540083
  CDS Start-End: 514-863
cacacacacacacacacacacacacacacacctttccagttccccatgcacatttatgggtaatcgtgttgcttgccactctggattatctgatttattttttgtactgttgtcaatttcgtcaccaactgtcatcatccaccattcggtttttccttcagcagttttaccagtgagcaaagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgggcgcagtgctttcattggcattggcttcacagatcggggagatgccttcgactttaatgtctccttgcaggatcacttcaagtgggtaaagcaggaatctgagatttccaaggaatctcaagaaatggatgctcgtcctaagttggatctgggcttcaaggaaggacaaaccatcaagttgtgtatcgggaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttcagcactgcctc

SEQ ID NO: 158148 - DNA, 582 bp, Homo sapiens
  Payload ID: 10963
  Gene Symbol: NECAP1
  Gene Name: NECAP endocytosis associated 1
  ENST ID: ENST00000541948
  CDS Start-End: 8-340
acccaagatggcgaccgagttggagtacgagtctgtgctgtgtgtgaagccagacgtcagcgtctaccggattccgccccgggcctccaaccgcggttacagggcctctgactggaaattagaccagcctgattggactggtcgcctccgaatcacttcaaaagggaagactgcctatatcaaactcgaggataaagtttcaggggagctctttgctcaggcaccagtagaacaatatcctggtattgctgtggagacggtgacagattctagccgctactttgtaatccggatccaggatggtactgaacattacaaacaagaaaggaggtgcttctaagcccaggactgcaaggggtgggggtctgagcttactcccacccccgccaggaggcaaagtcactattcccccaccatcctcctcagttgccatcagcaatcatgtcaccccaccacccattccgaaatctaaccatggaggcagtgatgcagatatccttttagatttggattctcctgctcctgtcacgacaccagcaccaactccagtttctgtaagcaatgacttgtggggagacttca

SEQ ID NO: 158149 - DNA, 2070 bp, Homo sapiens
  Payload ID: 10964
  Gene Symbol: NECAP2
  Gene Name: NECAP endocytosis associated 2
  Uniprot ID: Q9NVZ3
  ENST ID: ENST00000337132
  CDS Start-End: 91-882
gaaacctggtcagagagtcgcaccgcttccgtccgtcggacagaggaacggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgtttatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtca

SEQ ID NO: 158150 - DNA, 1929 bp, Homo sapiens
  Payload ID: 10964
  Gene Symbol: NECAP2
  Gene Name: NECAP endocytosis associated 2
  Uniprot ID: Q9NVZ3
  ENST ID: ENST00000443980
  CDS Start-End: 27-848
aagttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcagatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactgtttcctgggattcaagtatgcaaccagaacacaggagaagaaaagctccaggatccctgtccccatctgtcctcttgatgtgagagagactctgagacttcttccatcgcaatgacctgtattaaacacaagccccccaagcaaaagaagaggttgagtttgctgccaggattcagatcagcccttcccagggtctgcaggtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgtttatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtc

SEQ ID NO: 158151 - DNA, 935 bp, Homo sapiens
  Payload ID: 10964
  Gene Symbol: NECAP2
  Gene Name: NECAP endocytosis associated 2
  Uniprot ID: Q9NVZ3
  ENST ID: ENST00000457722
  CDS Start-End: 39-752
ggaagtcgccggaagttcggtgggctccaggcgtcgcgatggaggagagcggggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacactg

SEQ ID NO: 158152 - DNA, 981 bp, Homo sapiens
  Payload ID: 10964
  Gene Symbol: NECAP2
  Gene Name: NECAP endocytosis associated 2
  ENST ID: ENST00000459640
  CDS Start-End: 7-591
gtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcattggccagctggcccttaagagagaaatgcaagtccaatccagtggactggttgggatgtgattctttctctcgcttggaggaaactaacatttaatgagcatcagctgagggccagaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaagga

SEQ ID NO: 158153 - DNA, 727 bp, Homo sapiens
  Payload ID: 10964
  Gene Symbol: NECAP2
  Gene Name: NECAP endocytosis associated 2
  ENST ID: ENST00000504858
  CDS Start-End: 26-331
agttcggtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatggtgggtgaaacagcagtgtgaatttgcaaaacaagcccagaacccagaccaaggccctaaactggacctgggcttcaaggagggccagaccatcaagctcaacatcgcattggccagctggcccttaagagagaaatgcaagtccaatccagtggactggttgggatgtgattctttctctcgcttggaggaaactaacatttaatgagcatcagctgagggccagaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcag

SEQ ID NO: 158154 - DNA, 713 bp, Homo sapiens
  Payload ID: 10964
  Gene Symbol: NECAP2
  Gene Name: NECAP endocytosis associated 2
  ENST ID: ENST00000513161
  CDS Start-End: 1-191
gcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctc

SEQ ID NO: 158155 - DNA, 768 bp, Homo sapiens
  Payload ID: 10964
  Gene Symbol: NECAP2
  Gene Name: NECAP endocytosis associated 2
  ENST ID: ENST00000504551
  CDS Start-End: 42-650
ggtggaagtcgccggaagttcggtgggctccaggcgtcgcgatggaggagagcgggtacgagtcggtgctctgtgtcaagcctgacgtccacgtctaccgcatccctccgcgggctaccaaccgtggctacaggggagctctttgctcaggccccggtggatcagtttcctggcacagctgtggagagtgtgacggattccagcaggtacttcgtgatccgcatcgaagatggaaatggtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctc

SEQ ID NO: 158156 - DNA, 1787 bp, Homo sapiens
  Payload ID: 10964
  Gene Symbol: NECAP2
  Gene Name: NECAP endocytosis associated 2
  Uniprot ID: Q9NVZ3
  ENST ID: ENST00000492095
  CDS Start-End: 20-811
gtgggctccaggcgtcgcgatggaggagagcgggtacgagtcggtgctctgtgtcaagcctgacgtccacgtctaccgcatccctccgcgggctaccaaccgtggctacagggctgcggagtggcagctggaccagccatcatggagtggccggctgaggatcactgcaaagggacagatggcctacatcaagctggaggacaggacgtcaggggagctctttgctcaggccccggtggatcagtttcctggcacagctgtggagagtgtgacggattccagcaggtacttcgtgatccgcatcgaagatggaaatgggcgacgggcgtttattggaattggcttcggggaccgaggtgatgcctttgacttcaatgttgcattgcaggaccatttcaagtgggtgaaacagcagtgtgaatttgcaaaacaagcccagaacccagaccaaggccctaaactggacctgggcttcaaggagggccagaccatcaagctcaacatcgcaaacatgaagaagaaggaaggagcagctgggaatccccgagtccggcctgccagcacaggagggctgagcctgcttccccctcccccaggggggaaaacctccaccctgatccctccccctggggagcagttggctgtggggggatccctcgtccagccagcagttgctcccagttcaggaggtgctcctgtaccctggccacagcccaatcctgccactgctgacatctggggagactttaccaaatctacaggatcaacttccagccagacccagccaggcacaggctgggtccagttctgacctgagcacggtttttcctcatgtgacttctgggaaggcgctccctcatctgggccaaaggaaggaggacgaagccctcctcagctggcctgtgtttggggcatgaatctctcctctcctccttgtctggctctgttgacaaaccgggcatgtttggcagtaaattggcaccgtgtcacatgatcacagttcagcgggaggctttccgtacccacactggctgtagccacttcagtccatctgccctccagaggaggggtttcttcctgatttttagcaggtttagaggctgcagcttgagctacaatcaggagggaaattggaaggattagcagcttttaaaaatgtttaaatattttgctttgctaatgtgctgatccgcactaactcatctttgcaaaaggaactgctccctcggcgtgccccagctggggcctctgaagggattcctcactgtgggcagctgccctgagcttcaggcagcagtgtttatctctggccagttgtctggtttccatgtattctaggccaggtaggcaacacagagccaaggcgggtgctggaagccagacggaacagtgttggggcaggaaggtggatgctgttgtcatggagctgtgggagttggcactctgtctgctggtggccctctcggctcacatgttcacagtgcagctcctggcagacttgggttttctctttggtggtttctaaagtgccttatctgcaaacaacttcttttctccttcaggaactgtgaatggctagaagaaggagctcagtaaactagaagtccagggttgcttggtttactggtttataagaaatctgaaagcacctctgacattccttttattaactcacctctcagttgaaagatttcttctttgaaaggtcaagaccgtgaactgaaaaaagtgttggcctttttgcgggaccagatttttaagataaaataaatatttttacttctgtc

SEQ ID NO: 158157 - DNA, 1931 bp, Homo sapiens
  Payload ID: 10965
  Gene Symbol: NDN
  Gene Name: necdin, melanoma antigen (MAGE) family member
  Uniprot ID: Q99608
  ENST ID: ENST00000331837
  CDS Start-End: 114-1079
cggaaggcgccgcgcgcagcaacgcgcacttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaacaaaaataa

SEQ ID NO: 158158 - DNA, 1681 bp, Homo sapiens
  Payload ID: 10966
  Gene Symbol: NDNL2
  Gene Name: necdin-like 2, SMC5-SMC6 complex component
  Uniprot ID: Q96MG7
  ENST ID: ENST00000332303
  CDS Start-End: 125-1039
agcacgcagtctcagccgacactgcgcgcgcctccaggcaccggcgttagcgggtcgccgacccgcaatccccgccgcggctgcttgcctaccggagtgtgcgccggcacctgccgccggagacatgttgcaaaaaccgaggaaccggggccgctctggcggccaggccgagagggacagagactggagccatagcggaaaccccggggcttcgcgggccggggaagacgcccgggttctcagagacggctttgccgaggaggccccgagcacgtcccgcgggccgggcggctcgcaggggtcgcagggcccctcgcctcagggcgcccgccgggcccaggccgcccccgccgtggggcccaggagccagaagcagctggagctgaaagtgtccgagctggtgcagttcttgctgattaaagaccagaagaagattccgatcaagcgggccgacatactgaagcacgtcatcggggactacaaggacatcttccccgacctcttcaaacgggccgccgagcgcctccagtacgtcttcgggtataagctggtggaacttgaacccaagagcaacacttacatcctcatcaacaccctggagcctgtggaggaggatgccgagatgaggggtgaccaaggcacgcccactacgggcctcctgatgatcgtcttagggctcatctttatgaagggcaacaccatcaaggaaactgaagcctgggactttctgcggcgcttaggggtctaccccaccaagaagcatttaattttcggagatccaaagaaactcattactgaggactttgtgcgacagcgttacctggaataccggcggataccccacaccgaccccgtcgactacgaattccagtggggcccgcgaaccaacctggaaaccagcaagatgaaagttcttaagtttgtggccaaggtccataatcaagaccccaaggactggccagcgcagtactgtgaggctttggcagatgaggagaacagggccagacctcagcctagtggcccagctccatcctcttgaaaggtggattcagagggacccccgggacaagggtctgagacccaaaggcacagtttagaggattgggggaagggagaacgaacccagggagcatattgctgtaaacgcttcaatgtgtgtagctttaggatgtgtttgcaaagttttgtttttttaatgttgtgttattttgctccagattttcatctataaacaaaggagcatttgttttgattttactctttttggtataaaaaattttgctagcttagtaaaacgaattggaaaacttgactatgatctggaacagataatgcaagaaggaacacataagtaagttgctttggtgccaagaaaataaaaaagctattatcaggtctcctaactaccccagtttgtaaggaaaaataaaagtttttataaaattaaaaaaaataattgcctatatccttattatgttaacctattttatttttctatatttcgtacatatataagtattattcatggttccaagcaatgagtgtaatgtattttctcccaatagtaattgtttatattcataattattcagctctgctgctaaacacgtagttccacttcgtttttttcttcttgctactgtagttattacaataaatactgtatttttgaagcacttaa

SEQ ID NO: 158159 - DNA, 1681 bp, Homo sapiens; identical to SEQ ID NO: 158158
  Payload ID: 10966
  Gene Symbol: NDNL2
  Gene Name: necdin-like 2, SMC5-SMC6 complex component
  Uniprot ID: Q96MG7
  ENST ID: ENST00000631973
  CDS Start-End: 125-1039

SEQ ID NO: 158160 - DNA, 7106 bp, Homo sapiens
  Payload ID: 10967
  Gene Symbol: N4BP1
  Gene Name: NEDD4 binding protein 1
  Uniprot ID: O75113
  ENST ID: ENST00000262384
  CDS Start-End: 238-2928
ggcccggcccgcggcggcggcaaaggggcggaggggttcgctgccagcaattgccaagctgctgcggtcgtggcgggatggtatagccgggcctgagggcgggcggcggggcgcgggcgggggcgaggcggccgggaagggccgacgccgcctgactggcttgggagcagcggcagcaagctgagggggcgtcgccgccgccggcccccggcgccgccgcgggaggccgcgcccgccatggcggcccgggcggtgctggacgagttcactgcgccagctgagaaggcggagctgctggagcagagccgcggccgtatcgagggcctgtttggcgtgagcctagccgtgctcggcgcgctaggggctgaggagccgctgcccgcgcgcatctggctgcagctctgcggggcgcaggaggcggtgcacagcgccaaggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatgaaactgttttgcaggaagaggcaagaaataaagctgggactcctgtttctgagcttacaaaacaaatggacacagtcctttctagctcaccagatgtgctttttgatccaataaatggtctaaccccagatgaagaggcactttccaatgagagaatttgtcagaaaaggagattttctgattctgaagaaaggcatacgaagaagcagttttctttggaaaatgttcaggagggggagattttacacgatgctaagacattggctggaaatgtaatagctgacctatctgattcttctgctgattctgaaaatttaagtccagatataaaagaaactactgaggaaatggaatacaacatcctcgtaaacttttttaaaaccatgggctactcccaagaaattgttgaaaaggtcattaaggtgtatggaccatctactgaaccattattgctcttagaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacccatggtctgaaaaagttcttttcttgtcgtggaattgcaattgcagttgaatatttttggaagcttggcaacagaaacatcactgtatttgtccctcagtggagaacaaggcgtgatcctaatgtcacagaacagcacttcttaacccagctccaggagctcggaatattatctttaactcctgcccggatggtctttggagaaagaattgcttctcatgatgacaggtttctactacacttagcggacaaaactggtggcataattgtgacaaatgataatttcagagaatttgtgaatgagtcagtctcttggagagaaattattacaaaaaggctgctgcagtacacgttcgtgggggacatatttatggttcccgatgatcctctgggaagaagtggacctcgattagaggagtttcttcagaaggaagtctgtcttagagatatgcagcccctactcagtgccctgccaaatgtgggcatgtttgaccccagcttcagagtccctggcacccaggcagccagcaccagccaccagcctccgacccggattcagggagccccttcaagccactggctccctcagcagccccacttcccactgctgccagccctccccagtctccagcagaacctgcccatgccagctcagagatcttctgcagaaaccaacgagctgagggaagcccttctgaagatcttccctgactcagagcaaagactgaaaatagaccagatcttggtggcccacccatacatgaaagatctaaatgcgctttctgccatggtgttggattgaagattgtgctgagcgctgagcttgcgctcagggctggctgatcaaactcaagctcacacctgtacctgatgggaatgaacataatgtgaagaaacttatttcccagtgtaaacgcagttgtacagaaaaaaaatgttttgggtataaatctgggttttcaaaaccagcttttttctatatataaattatgctgctattacagatttaacattttctgttaaaggaaagtctacattttctgcctgttcagaactgtttaatagcagttactcttgagtgtatttacctttttatgttttttaaactattttccttaaagccgaaaatattgacaaatggatatggttagcctttataaataaataaaaaaaaaagtgttgctttcttaaggaaagcaagacgtcttaaagtatattttcttgagatgagtatgtcccatcactaccatgaagtgtgctcacccttccagcctcctctgccctcacccccggagttaaagtgggtaagagttggtttgttctgcagtctttggttggagtgttgtgaaagtggacccgcggtgccactagatggcacttggtgcctagccatggtgaatgaccagggcgaagttagtctcacagaataccagggctagaagacatcgtggagcccatggagtcccaccctccttcccccttccaccctgcgcaaaaggggacggcccagtgtgcacgccgtccggccatgcccacagccacagccacagctgaggagtggccgggcaggcagcaggctccccagccagggcttgacacgcccacagtcaggggcctccacatgcctggcctggctctggaagtcacgtcttagcttctgaacaccgtagcgggttatgaggaagtttaatgaagagcccggtcactgtggccatcttgtgtccccaactgcaggagacgccctgatgtggagtttgtacagctttgccaaaaaatggttttctattctcaaaagtgacccaagccaataaatagcattagtagcttctgtggggggatcccagagcccctgtatttattttccctgtgtttgtctctagtgtcctcctaaacagcctttcctgtgagtctttctcagaattgatatcttaatattgtctgttctaggtgttgcccaaattcagtgtcagtgaagttcttttcctgggcaatcttaacatctttactcttattgtctggaccttcaaagggctttgtattttacacctgcgcccccaggctgctcacagtcggcttgctgcctgtcctgcctgtccggatcttgtctcctagtcctgaggagcggaggctgagaactcagtgctggtttgtaaatggtgaggggacttgggggcatcccagagtgctccctccaggcctgcttcttggttttgtttgatcactgcgttcttcaagggatgaatccagagccctccatgaggccaagcttgtccttcaatcatgtttcctctcagatgcgtccgtgatgcctcctaatgtggaactggttgtccattgtttgggcctatggccaagtcacccagctgtggaagcagaggtagaagacgaggccagccaggagggcgacttcagtcacagctcccatgcctcagctttgtacctgttttcaaaagcacaactgaggtgtgcgggctggagctgtcttgcagtgattctggccttctggctcatggttcagtccagcagcctggctgacccactatttctcctctgcttcagaggaaacccaggaaatgcccttactgccaggctgagtctccacccatgctggttggtgctggctaggctgagggggccaccacttttcctggctagaagctacttgacctttgatgtttgagttctgtaagtcttcgtgttctgacttactgcttcagagggattggcctgtcccctttccctttctcggctatgggaaggaaggattgctcattggttgccttcatcagttacagcatgagacggaattcatcattccttccgaaacccctgatatttaatatttaatatttaaaaacccaaattatcaaaccattaagaactcattactggttctcagcctcctccagtactagcctcagtgtggctgctgcataagtatctgtagcctgtctacctcctgcagtggggccgctcgcctcttccctgtctactgctcaggctctcccacttcgtggcatccatgtaaagtaggtggcagggcagagatgtcactctcattcaacagggaggatgtctgttgctcagagaggttgtcctgaggggctgggtgattcctgggcctacattcttcccgaggctccaggccgctgtctctggaagtaaaagagccttgtctgaccttaatgcaagcagtctgtttgaacccctgtaggctgcattcaggagacagaaggtgtctgggccatcctgggcggccggtcagcgttgctaggcaggctcggctgtctggccgggacttgggcctgggtggcttttgagaccagtgaagaagggagagccggcctcatgccgatgcggcttgtggcacggctgggatgtgagggaggactcagatctacacacagaaacccctcttctccccgccctcccccagctcctacctgcctcccacgcctcaggtgtggctgcctgtgggaccatcccccaacccctttcctcgcacctccttgtcctcacccagttcctgcagtgtctctgacccacgcctcccgcctcctggccgacttgcccaggaggtgtctctggctcacctccgtctgttcatcaccttcctccccagtgtttccacttatcttggatgttttagattgaaacagcctgattcccggaagaatcctcttcattcattgctagtgcttcccctcacctcccactctccacttcccagtttgcaaatgtggctttcgcccaccaagtgaaagcggactgagagcagcccttggggacggcccggtgcctggctgcaaggccgcgctggggctctgtcttggtgcacatggcttgaccggactttccctgcttcccaccacttccctcactcccagacctccctcattctttttgtctcttctttttgcctaaagccagtccttaacaccctattcttcctctgcaggtggcttgcagacttttccccacctttggggctcgtggtggtggagagggcagctggtgttaagaatgtaggttaccgggcatgacccggcagatgcttgcccagtagttctggaggaaggcccgggaatctgcaaatgagcgcattccccaggcagttcccatgcaggtgatccacggaccacatgttgagaaactgcagtcacccttagggccacaccgtccctctcctcgctgtcccctctctgtagtgactggccctgaccttcaggagtgcactttccactctaccaggaagccctatgacatcctcaggctccccagacctgcagcttgcatggggcccctcccttcttccacacccaccctccgtatggtcccctgctctgccctcgtgctttgctggcccctgcccgctactcccactctcagacacccaggggtggtgggccctaactggctggcccctcccagcgctgccctctgccgtccagatgctgcagtgtggccagatttaccttccagtaacatacttctagtcacccctcctcctgcgaagtgatctgcagtggctgtttgaccagaccacaaagttcacatctcctgagcttagtgtccgtggctgtccacctcccagccatacttgactgtccccaaactctccctgcagccacatgtttcccatgacctgtgggctctgcagatggacctctctccgctagagatgcccttctcccaaatggcttccctcctggaaggcccagcctgagtcctcgtctcctttccagtgcttctgccagaagcatccccatgatgttgtgaccgcacagcactttgtgtctcgctttgagcacttgccactctggctggtgctgctgccactgattgtgtactgtcttgctgccctttctagactgtgagctcctcgtgggcagggaccgcctgtgttctctgtatttcccacggcgcctagcacagtgccttgcacttgataggtgcttaataaatgtctgctcaactgaa

SEQ ID NO: 158161 - DNA, 540 bp, Homo sapiens
  Payload ID: 10967
  Gene Symbol: N4BP1
  Gene Name: NEDD4 binding protein 1
  ENST ID: ENST00000564710
  CDS Start-End: 114-540
aaaggaattctgaggatgactctgagggccaaggggtgcctcagtagttgtgggaatatattaaaggaatctgtgaacctgaactagaagaaagagaatgttaccccaaggacatgcactgcatttttgttggggcagagagcctgtttctgaaaagcttgattcaggatacttgtgctgacctctgcattctggacattggccttcttggcatcagaggaagtgctgaggctgtggtcatggctaggagtcacattcaacaatttgtaaagctctttgaaaataaagagaacctacccagtagtcagaaagaatcagaggtgaaaagggaattcaaacaatttgttgaagcccatgcagacaattacacaatggatttgttgattttgcccacttccttgaaaaaagaacttttgacactcacacaaggtgaggagaatctctttgaaacaggagatgatgaggttattgaaatgagagattctcaacaaacagagtttacacagaatgctgccacagggctgaatatttctagagatg

SEQ ID NO: 158162 - DNA, 9744 bp, Homo sapiens
  Payload ID: 10968
  Gene Symbol: N4BP2
  Gene Name: NEDD4 binding protein 2
  Uniprot ID: Q86UW6
  ENST ID: ENST00000261435
  CDS Start-End: 417-5729
ttccccggccggacggagagcggcagtgtctccccgccgggcgcgctcgccgtgtctcccccgcggccgcagctgcttgctagccttgcgcggcgcgggagagcgcagtggcgccggcgggaaagggctgcggacctgcggcgccgcgttgtgcgttcgacgacgcggcaccggcttcgacgccctctgcccgctccagaagcagtaagaagacatgttggataacaagaagaggtgtagagtttgcatatatcaactgtggccttaatgagcatgttgacagcatcgatgctagacagacagtctttttactgctggattgtgcaagatatttaaccctattttgtttgaattatgacttaaatgtcaaacatcttaactaagaaaagggaaacattttagttttggaagtcagaatgccaaggagaaggaaaaatcttgggggaaatccttttcggaagactgcaaaccctaaggaagttgtcgtatccagtgttgctagtcgtgaggagccaaccactactctaccttccatgggtgagacaaaagttgatcaggaagaactcttcaccagtatctcagagatattttctgatctggatcctgatgtagtgtatttgatgctttctgaatgtgatttcaaagttgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttggaaagtaactacccggaagattctcttctcagtagttctttaaatgtagcaagtgactccatcgcaggttgtagcagtctcaatcaaaaacagaaagaacttttagaatctgagtgcgttgaggctcaattctctgaagctcctgtagatttggatgccagtgaacctcaggcttgtttaaaccttccagggcttgatttaccaggtacaggtggggatcagaaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaagccaaagaaattaaaagagactgaagaaacaccaagtgaactgtctttccaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccaca

SEQ ID NO: 158163 - DNA, 724 bp, Homo sapiens
  Payload ID: 10968
  Gene Symbol: N4BP2
  Gene Name: NEDD4 binding protein 2
  ENST ID: ENST00000515550
  CDS Start-End: 204-724
gcgccggcgggaaagggctgcggacctgcggcgccgcgttgtgcgttcgacgacgcggcaccggcttcgacgccctctgcccgctccagaagcagtaagaagacatgttggataacaagaagaggtgtagagtttgcatatatcaactgtggccttaatgagcatgttgacagcatcgatgctagacagacattgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttggaaagtaactacccggaagattctcttctcagtagttctttaaatgtagcaagtga

SEQ ID NO: 158164 - DNA, 9747 bp, Homo sapiens
  Payload ID: 10968
  Gene Symbol: N4BP2
  Gene Name: NEDD4 binding protein 2
  ENST ID: ENST00000511480
  CDS Start-End: 330-629
gcgcggcgcgggagagcgcagtggcgccggcgggaaagggctgcggacctgcggcgccgcgttgtgcgttcgacgacgcggcaccggcttcgacgccctctgcccgctccagaagcagtaagaagacatgttggataacaagaagaggtgtagagtttgcatatatcaactgtggccttaatgagcatgttgacagcatcgatgctagacagacagtctttttactgctggattgtgcaagatatttaaccctattttgtttgaattatgacttaaatgtcaaacatcttaactaagaaaagggaaacattttagttttggaagtcagaatgccaaggagaaggaaaaatcttgggggaaatccttttcggaagactgcaaaccctaaggaagttgtcgtatccagtgttgctagtcgtgaggagccaaccactactctaccttccatgggtgagacaaaagttgatcaggaagaactcttcaccagtatctcagagatattttctgatctggatcctgatgtagtgtatttgatgctttctgaatgtgatttcaaagggaacttaattgggtgcttactaggtgccagttcttgtgcacagcactttttcatggattatctcatttaatcctcacagcaacctatgagttgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatggattcatttttggacatgcagctaactgaagacctggattccttaatacagaatgcttttgagaaattgaactcttctcctgatgaccaagtatactcatttttgccttcacaagatgttaatagttttaatgactcaagtgagtttataaatcctgattcaagtaatatgactcccattttttctacacaaaatatgaatttgaacggtgaaaatttagagaattctggttctactttaagtttaaacccattaccttcacattcagttttgaacgagtccaagtgttttataaaggataacacattggctttggaaagtaactacccggaagattctcttctcagtagttctttaaatgtagcaagtgactccatcgcaggttgtagcagtctcaatcaaaaacagaaagaacttttagaatctgagtgcgttgaggctcaattctctgaagctcctgtagatttggatgccagtgaacctcaggcttgtttaaaccttccagggcttgatttaccaggtacaggtggggatcagaaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaagccaaagaaattaaaagagactgaagaaacaccaagtgaactgtctttccaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttgctgttaactctgtactttttaaattgaaaatgttttataaatttgcttttaaattttcttatgaagccatttgcaaattacatacttaatttaataaaatactttagccac

SEQ ID NO: 158165 - DNA, 5361 bp, Homo sapiens
  Payload ID: 10968
  Gene Symbol: N4BP2
  Gene Name: NEDD4 binding protein 2
  ENST ID: ENST00000513269
  CDS Start-End: 1-4201
gcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggactttgcaagaggataatccaagtggagtcattcttagtactgatgattatttttatataaatggacagtaccagtttgatgtaaagtacttaggagaagcacatgaatggaaccagaatcgtgcaaaagaagcatttgagaagaagatatctcctataattatagataatacaaacctacaggcatgggaaatgaaaccatatgttgctttgtctcagaaacacaaatataaagtcctttttcgggaaccagacacatggtggaagtttaaaccaaaggaacttgcaaggcgtaacattcatggggtaagcaaagaaaaaataacaagaatgttggaacattatcaacgttttgtttcagtgccaataattatgagttcttcggttccagagaaaattgaacgtattgagttgtgtgcatattcttgtgaggatagaagcactagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtcatgggcaacacacatcgttgcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccagcgatggccaaatctctgaccatagactgtctggaattggcattaccccctgaactggcttttcaacttaatgaattatttggtcctgttggtattgattcagggtctctaacagttgaagattgtgtggttcatatagatctgaatctggcgaaagtgattcatgagaaatggaaagaatctgtaatggagcgacaaagacaagaagaggtgtcttgtggcaagtttatgcaagatccttccttggttggacatactgggcttgataatcctgaacaaaaatcatctcagagaacaggcaaaaaattactgaagactttaacagcatctgaaatgctacctttattggatcattggaatactcaaactaaaaaagtatcactcagagaaataatgtcagaagaaattgccttacaggaaaaacataatttgaaaagggagacccttatgtttgaaaaagattgtgccactaaactaaaggagaagcagctctttaagatatttccagccattaaccaaaattttctggtggacattttcaaggaccacaactattcattagaacacacagtgcaatttcttaactgtgttcttgaaggggaccctgtaaaaacagttgtagcccaagagtttgttcaccaaaatgagaatgtcacatctcatactggccagaagtctaaagagaaaaaggactttgagtacccagactatgatgactacagagcagaggctttccttcaccaacagaagaggatggagtgctacagcaaggccaaagaagcttatcggatagggaaaaaaaatgtcgccaccttttatgcccagcagggtactcttcatgagcagaagatgaaagaagccaatcaccttgctgccatagagatctttgagaaagtcaatgcttcgctgctgccacagaatgttttagacctccatgggctgcatgtggatgaagctctagaacatttgatgagagttttagagaagaagactgaagaatttaagcagaacggtgggaagccctatttgtctgtgattacggggagaggaaaccacagccagggaggagttgctcgcatcaaaccagctgtcattaagtacctcataagccatagcttcaggttctctgaaattaaaccagggtgcttgaaagtcatgctaaagtaaaataaacatccttgaattagaagtatgaaggtttgtaggttaaaattacttttatttgcagtaattcagtcaattctaccctaaagatgtgttttattataaataatattcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctcc

SEQ ID NO: 158166 - DNA, 1789 bp, Homo sapiens
  Payload ID: 10969
  Gene Symbol: N4BP2L1
  Gene Name: NEDD4 binding protein 2-like 1
  ENST ID: ENST00000343281
  CDS Start-End: 49-231
gacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccaggtgaaaatgtttgatgtgccggctcctttacctcatagttacagtaagaagaaatttaaaaattgggatcaaagatgcagccgccttcccatttaagcagcacagacagcccaaagtgacagttttcctgtacagttactcttctgttatctgtaactgatctatgacattttgggaaaaaacagccaaaaaaaattagtactgagatgctcagaatggagcagtggacaaaggagacaaaaatccctgccttcatggaacatgtattctatcagagaaaaaaaattctcaaggaaaaaaggcaattttagcatctgctctgctctgttctctcaaaaaataagcaaaggatttcacaggtatgccaccggaggtatatatccccaggaaatgtccacatacacacaagagtgttctaggtacttgggaatcatcagtgaacaaaacaaagatcctgcccttgtggaccttatgtgccagaggctcctgaccaccataaagatagaactggggcttaaccctcatcacttctgaagctgatggaatgacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatc

SEQ ID NO: 158167 - DNA, 3046 bp, Homo sapiens
  Payload ID: 10969
  Gene Symbol: N4BP2L1
  Gene Name: NEDD4 binding protein 2-like 1
  Uniprot ID: Q5TBK1
  ENST ID: ENST00000380130
  CDS Start-End: 97-828
atcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagccttataatttagttgcttatatatttgatctgtgtacatgagactgttttaacgttatctgacactactgaaacctgctcgacatctccatgactaccaacaccatgtgtaatgttttcttcactaacattttaaaaactggtatctcctttgagtaagtttggctgacaatagtaaatcccaatgaatctaaggtgttatcagctttgctaacttctgtatctccaagcacaacataaaataatctcctaatgatctacttaataatgctcccattttccaggcccaggtagtcctgggtatcttggttgatagggtggtggcataaccagctcaatatggatggcttgactcgtctgggctggtagaggggagaaatgtcagagagctcaaagtggaaattaccatcctttgatttcacatgagcggttcaaaggaccagattcaagccctcctgacttggctggctccctgctttagggtttttggctcacttgggttaagtgagtgaccactatggagaagtggctctgggttacataacttttctagagctctaaagaatagtttcctggcctatttaatgtctcttctttccctagctgacccctgaaatatttggtttgtaaaccataaaaattgattaaatgccatcaactttatcccctgtagaagtgatctgtttttcaactcccatggcttctgatttgtgtaactctttgaacacccaatattgacttgtattgtgttcgctgtttgcatcattcatagaactggcaaatgctctttatgggcaatagggtctcattaaatgattgctgaataaataacacaaatttttaccatt

SEQ ID NO: 158168 - DNA, 903 bp, Homo sapiens
  Payload ID: 10969
  Gene Symbol: N4BP2L1
  Gene Name: NEDD4 binding protein 2-like 1
  Uniprot ID: Q5TBK1
  ENST ID: ENST00000380133
  CDS Start-End: 52-783
cgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagttggaatcagatttaatgtgagatcatgatagacaagaccacagaggacgtatgctctatttcttgttggccaacagcttctttc

SEQ ID NO: 158169 - DNA, 2994 bp, Homo sapiens
  Payload ID: 10969
  Gene Symbol: N4BP2L1
  Gene Name: NEDD4 binding protein 2-like 1
  Uniprot ID: Q5TBK1
  ENST ID: ENST00000380139
  CDS Start-End: 52-573
cgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggtatttcagaccgaacaaaagaatcttttcaggctggaaatggacatggtagttttcaggccagaaatgaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagccttataatttagttgcttatatatttgatctgtgtacatgagactgttttaacgttatctgacactactgaaacctgctcgacatctccatgactaccaacaccatgtgtaatgttttcttcactaacattttaaaaactggtatctcctttgagtaagtttggctgacaatagtaaatcccaatgaatctaaggtgttatcagctttgctaacttctgtatctccaagcacaacataaaataatctcctaatgatctacttaataatgctcccattttccaggcccaggtagtcctgggtatcttggttgatagggtggtggcataaccagctcaatatggatggcttgactcgtctgggctggtagaggggagaaatgtcagagagctcaaagtggaaattaccatcctttgatttcacatgagcggttcaaaggaccagattcaagccctcctgacttggctggctccctgctttagggtttttggctcacttgggttaagtgagtgaccactatggagaagtggctctgggttacataacttttctagagctctaaagaatagtttcctggcctatttaatgtctcttctttccctagctgacccctgaaatatttggtttgtaaaccataaaaattgattaaatgccatcaactttatcccctgtagaagtgatctgtttttcaactcccatggcttctgatttgtgtaactctttgaacacccaatattgacttgtattgtgttcgctgtttgcatcattcatagaactggcaaatgctctttatgggcaatagggtctcattaaatgattgctgaataaataacacaaatttttaccatta

SEQ ID NO: 158170 - DNA, 1897 bp, Homo sapiens
  Payload ID: 10969
  Gene Symbol: N4BP2L1
  Gene Name: NEDD4 binding protein 2-like 1
  ENST ID: ENST00000530622
  CDS Start-End: 219-632
ccctaatgcatgaggctcctgaccaccataaagatagaactggggcttaaccctcatcacttctgaagctgatggaatgacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacc

SEQ ID NO: 158171 - DNA, 541 bp, Homo sapiens
  Payload ID: 10969
  Gene Symbol: N4BP2L1
  Gene Name: NEDD4 binding protein 2-like 1
  ENST ID: ENST00000495479
  CDS Start-End: 1-478
gcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggttggaatcagatttaatgtgagatcatgatagacaagaccacagaggacgtatgctctatttcttgttggccaacagcttcttt

SEQ ID NO: 158172 - DNA, 1145 bp, Homo sapiens
  Payload ID: 10969
  Gene Symbol: N4BP2L1
  Gene Name: NEDD4 binding protein 2-like 1
  ENST ID: ENST00000464470
  CDS Start-End: 1-238
gcggccgccccggccgcccccgcgggggacacctcctcgccgccacagctttaggaaacacctctacctcctgcgaggcctcccgggctccgggaaaactacactggccagggacgactggagtgagcactggcctgggagtctgaagattgtgccttcagacctacttcgtcacttactagctggcgactttggtcagtcatctagtttttccgggccttatgttccttacatgtgactactaaaaggctactagattataggatttattaaagatccttctgactcttaatttccagtggtcagattaaaaatagtttgctaataatggctatgttaaagagctctgaccttggagtcaatttatggctccacatccaagctctaccattcactagttttgcttttcacccaacccctctgtgcctcggtttccttttctgttaaatggggatatctgttctgtttgcctctgagggttttgtgaacattaaatgtgtgtgggaggactttttaaacttaaagtgctatatacattttaagaggtgttagttactgctccgttgttggtcagctgagataaatcttcagtgttccctggatcctggctctggagtgaagaaggtagcttggcagttgactttgagtcctcccgtttcgctgggcattggcagttctgggagcagagcagccttggcatgccatggggtggattgtgtgtttatagaaaagtctgggacgtaagcgaggaaatgggccacagctcagcggaagggaggccggtggtgaggatggaatggtggagaggcaggctcaggtgtggcccaccaggagctgccttccccacttttttgggaggtagggtggggaagaagaaaagagcaaattgtttaaaaatacacatgtatatagaaaatagtaaaactgtaaggttatctgtgtgttgttggattctgggaaattcacattttctctattctctgtattttccaaattttctataacgaatatgtatttcttagaataaaaatttttttcttcaaaatttggaggaaatcgctttttacaaatgtgggttcatctttttctgcttaaccttttttctcatttgattaaagaactaataaaaatgtttttgaaattaa

SEQ ID NO: 158173 - DNA, 2032 bp, Homo sapiens
  Payload ID: 10969
  Gene Symbol: N4BP2L1
  Gene Name: NEDD4 binding protein 2-like 1
  Uniprot ID: Q5TBK1
  ENST ID: ENST00000613078
  CDS Start-End: 97-618
atcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggtatttcagaccgaacaaaagaatcttttcaggctggaaatggacatggtagttttcaggccagaaatgaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagccttataatttagttgcttatatatttgatctgtgtacatgagactgttttaacgttatctgacactactgaaacctgctcgacatctccatgactaccaacaccatgtgtaatgttttcttcactaacattttaaaaactggtatctcctttgagtaagtttggctgacaatagtaaatcccaatgaatctaaggtgttatcagctttgctaacttctgtatctccaagcacaacataaaataatctcctaatgatctacttaataatgctcccattttccaggcccaggtagtcctgggtatcttggttgatagggtggtggcataaccagctcaatatggatggcttgactcgtctgggctggtagaggggagaaatgtcagagagctcaaagtggaaattaccatcctttgatttcacatgagcggttcaaaggaccagattcaagccctcctgacttggctggctccctgctttagggtttttggctcacttgggttaagtgagtgaccactatggagaagtggctctgggttacataacttttctagagctctaaagaatagtttcctggcctatttaatgtctcttctttccctagctgacccctgaaatatttggtttgtaaaccataaaaattgattaaatgccatcaactttatcccctgtagaagtgatctgtttttcaactcccatggcttctgatttgtgtaactctttgaacacccaatattgacttgtattgtgttcgctgtttgcatcattcatagaactggcaaatgctctttatgggcaatagggtctcattaaatgattgctgaataaataacacaaatttttaccatt

SEQ ID NO: 158174 - DNA, 2519 bp, Homo sapiens
  Payload ID: 10969
  Gene Symbol: N4BP2L1
  Gene Name: NEDD4 binding protein 2-like 1
  ENST ID: ENST00000459716
  CDS Start-End: 230-640
cgtcacccttgttttccgggctgtgagtctcccagcgtccccagctttccaggtagggacgccccctcccacgcagcacggttccggcgggtggaaaggaggggctgggctcccagcgcccgcccctctatccatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagatgctcagaatggagcagtggacaaaggagacaaaaatccctgccttcatggaacatgtattctatcagagaaaaaaaattctcaaggaaaaaaggcaattttagcatctgctctgctctgttctctcaaaaaataagcaaaggatttcacagtgttctaggtacttgggaatcatcagtgaacaaaacaaagatcctgcccttgtggaccttatgtgccagaggctcctgaccaccataaagatagaactggggcttaaccctcatcacttctgaagctgatggaatgacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaa

SEQ ID NO: 158175 - DNA, 2009 bp, Homo sapiens
  Payload ID: 10969
  Gene Symbol: N4BP2L1
  Gene Name: NEDD4 binding protein 2-like 1
  ENST ID: ENST00000635178
  CDS Start-End: 49-330
gacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagtgttctaggtacttgggaatcatcagtgaacaaaacaaagatcctgcccttgtggaccttatgtgccagagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtct

SEQ ID NO: 158176 - DNA, 2959 bp, Homo sapiens
  Payload ID: 10969
  Gene Symbol: N4BP2L1
  Gene Name: NEDD4 binding protein 2-like 1
  ENST ID: ENST00000635608
  CDS Start-End: 1-499
gcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaaggcagatagtgtcttcaaagtggatctgtggactactccatcagaattgcctcaggtggctattaaaatccgagttcatggaccccattcagtagttggaatctctgaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagccttataatttagttgcttatatatttgatctgtgtacatgagactgttttaacgttatctgacactactgaaacctgctcgacatctccatgactaccaacaccatgtgtaatgttttcttcactaacattttaaaaactggtatctcctttgagtaagtttggctgacaatagtaaatcccaatgaatctaaggtgttatcagctttgctaacttctgtatctccaagcacaacataaaataatctcctaatgatctacttaataatgctcccattttccaggcccaggtagtcctgggtatcttggttgatagggtggtggcataaccagctcaatatggatggcttgactcgtctgggctggtagaggggagaaatgtcagagagctcaaagtggaaattaccatcctttgatttcacatgagcggttcaaaggaccagattcaagccctcctgacttggctggctccctgctttagggtttttggctcacttgggttaagtgagtgaccactatggagaagtggctctgggttacataacttttctagagctctaaagaatagtttcctggcctatttaatgtctcttctttccctagctgacccctgaaatatttggtttgtaaaccataaaaattgattaaatgccatcaactttatcccctgtagaagtgatctgtttttcaactcccatggcttctgatttgtgtaactctttgaacacccaatattgacttgtattgtgttcgctgtttgcatcattcatagaactggcaaatgctctttatgggcaatagggtctcattaaatgattg

SEQ ID NO: 158177 - DNA, 9427 bp, Homo sapiens
  Payload ID: 10970
  Gene Symbol: N4BP2L2
  Gene Name: NEDD4 binding protein 2-like 2
  Uniprot ID: Q92802
  ENST ID: ENST00000267068
  CDS Start-End: 166-1917
cggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtggggaggctctcttggctcacataatcgtgtctgtgtcacaaataatcattaaattagctattttcagctaacacatttgttgttgcacttgaaaaagagttagtgagcctgtcttggagtttaagtagtttcaaataaaaaaaggctacagtgcctcacaaaggatgttcccagcaagttgtttaaattcccagcaagttgttaaagtgtaaataaaaatatatgaaattgtattttaaatgtttttatattctcttgttgtaatactcttggctgttatggaagcacctgagtaatagagtggtgggtaggagctaggatgtttttctacaatcgaattttaaactaatttatctattttatagacactattgaacagttttttaatagttcatatctaaatctaacttttcataaaactttacggtttttccttcactaccttaaatatgcaagaaatactgacttggtatagggtaccttagttttctctattcattagacaggtaaaattatatttcagctgattgatctgtgtgacaaaattatttcttagctataatcagcacatcacttagttcaaacaaaattccccagcaaatgttagatagtaggtatatcagtcacctggggagttttcttcataatatgcatattcatcttgtaatgcatacatagttatcatcctccttctcaacccatctccctaaccccacatgcttgccagttcttgaagggataaagtgattctaataatgttttacttctctctgttcaatttaatgtgatataattctagtataaaaatattttggacagttgcttaacatggtcataagaggatttgtactatagaatatcttctagtactaatttttctgtagagcaaattatatttctctcactggatagtttttagatgtgtttcttcatataaaattaaaaactgagatggaattcatttcagaggtcttgtcattcatcccctgccttcaaaccaagctttacctagactaacctagataattaagcatttctctttgcaacatgaggaaaaaaacactactacttctcttaataccattgttaccaatgtcttctgaagaatatttcttcaacagttttgatttacttttttgatttactctttttaggggaaaaaaaacccagctaattacaatgctgtcttaaaaattaagcattatgattctttatatgttttacataatattttgtggcctttaagctttctcctaaaccagcacatcttgaatcccatagtatttctttgttttaaaaccttttgctattcctttcaactttagatattctctcacatctttatattactttttaagttgtcaggccaaaaactagattcactgctatcaacaaggtctttgttacattgcctttagtgaaataagaatatgattttatttgtactattcagtgctgttaacatttgaatgaatattacctttatcttgtttaatacgtgtgtttgtatatatttgttcatcttaactacgatgtaagaatatgctaattcatgttttgtgtgtaaatgtatattgtatacatatacacatcttcatctatgttttcatatattcttttatttcagagtaatacttgttggtgtttggacttgtgtttctaagtattttattctgtagattagcgcagtttgaaaattgtacaaaaggatttcattttgggacaggtgaaacaactcttaggtagactatatgtccctttctttctgtctgtcttcataaacttaggagtaatagtactataaatttagctttttggccgggcacggtggctaacacctgtaatcccagcactttgggaggccgaggtgggcagatcacctgaggtcaggagtttgagaccagcctgtctgacacagtgaaaccacatctctacttaaaatacaaaaatcagctgggtgtggtggtgtgtgcctgtaatcccagctacttgggaggctgaggggggagaatcgcttgaacctgggaggcagagtttgcagtaagcagagattgcgccacttgcactccagcctgtgagacagagtgagactccttctcaaaaaaaaaaattagtttttttaaaataacttttacatttatttttggaaagtagagtattacctttgggagaaacagattatgaggaaatatgttcatattaagtttattttaatttccagattttattatagacttgtcttcatctcctagttctgactactaaataataatcagttagagatcattcgtcattaccaattaattttttacattataatgttagccaactactgttgcatcacagagtccaaataaataaataaatcttactgaggctggaaagctaacattcttactcagaattaaacaaacaaggtcttgtcctgctacgtgggctggatggagtgtggtggcgtgatcatagcttgctgaaaccttgaactcctaggctcaagaggtcctcctttctcagcatcccaagtagctgggacttcaagcatgcactgccacacctggcttattttgcattaaaaaaatttttttgtagagatggggtcttgccttgtttcccaaactggtcttgtactcctggcctcaagtgatcctcccaaagtgctgagattacaggcatgagccactgcaccagctttagtgatttttttttttttttttgagacagagtctttctctggatcacccaagctggagtacagtggcatgatgtcagctcactgcaacctccacctcccaggttcaagcgattctcctgcctcagcctcccgagtagctgggattagaggcactcgccaccatacctggataatttttgtatttttagtagagacagtgtttcaccatgttggccaggcaggtctcgaactcctgaccccaggtgatccgcctgccttggcctcccaaagtgctgggtgggattacaggcatgagccaccacaccaggcctagttggtttttttaaagtggaaaaacagttgttttcctaaacattgtggctaattttaattaaaaacagaatggaggaatgaatatgcagtggaaatactaaaatcactgtttaaagtcattgcttggtgtttaaaaatctataaaaatgtgaaatttacaatttttcatcaaaattctattcagacagtcttttttgggggttggggttaagagatgaggtctctttctgttgtatagactggacttgaactggtctcaagtgatcctcctgcctcagcctacctggtagctgggattacaggcacccagccaggtataatgttagtggaatagacccctgctgctatgccctattctaaccatctccatcacaaataattaaagtggatattaatcatatttacctaagatggagtacatcttagttaagtagaatacaacttctagtttggttcagtaagattaaattgtatttatttttttgtttgttccataggtttagtgcagaagttacttttttgtggtaaatgaatttatgattttttatgtttcataattttagtgaaaattcttgtgtggtaattaatttgaacttttgatactgctttttaaccaggtaatctttattttcagtatttatctttgtaaaagataatgttagcttttttatatttttgtctgttttaaaagtaagattatttacaaaagactgaatttttttaattgttggagtgggtgatttaagtatttgaactttgcttatctcttgtctaattaatacagattctggaattttccagttttacgtatagataagttttgaaagtatgatttaagaggatatgaaatgtttgtattggctatacttgaatttttttattgcaaaaatgtctgattttctgagactggttttctaactatttataaagaaaattggttgtggtctctttggaaaatgtagaagaaatgtagttgtgtgttctagtgccttggccagataggcttgctagtctttattgaagtttaatgtattctgacatgaatacaataactaataagggctaaagttgtattgttgttgctttttttttcttaacatttgcaatccacattgaacagtgttttataacaaaatcttagcttatgattcagaataaataattcagaacattcagaataaataatttggtggcagcagcaggagttaagttagtgattttttagagttaagttttaggagctacaatttataaattaaaaattttcctattaaagttaccagctgtgtcttcgtgaattttctgaggagagattgtattaagggattaatgaatgtttggtgataagactggcatacaaatctttatttttaaaaggtatcattaaaacagttggcttccctgtatgtatactgtatttccttcttacacagtccttaggctggtaagaagtagtagtaaatttcttgaaatagaccctaaaaatatagggattagtgattgtcttatgtgtcattttgattccttttttactttgcaaagcagtatttagattgattcaatttagttgatttaaattgccaaatatgttaagcctaagttttcacttttgcatggtttgtaagtttcagagcaaaccttgaaaagctaatgattatgattattggcaactaagttcagaaaacatgtaaaagaatggctacaatttactctcaataatttagactacattgagtggtgtaatttttgtaatagaatatacatgtatgtaagcagtaatttggaagatctcctacagaaattcttttttttttttttgagacggagtctcgctctgttgcccaggctggagtccagtggcgcgatcttggctcactgcaagctctgcctcccgggttcacgccattctcctgcctcagcctcctgagtagctgggactacaggcgcccgccaccatgcccgggtaatttttttgtgtttttaatagagacggggtttcaccttgttagccaggatggtgttgatctcctgacctcgtgatccacccgcctcggcctcccaaagtgctgggattactggcatgagccactgcgcctggccagaaattcttaatgtattatcactctatgcacaagaacaagaagaaggagtagcacaaataactttggaaagagagtctcaacagtaaatagttattctagaagctaagctgtatgtattgaaaagttttgactttttgtatatccaatagaaatttatttaatcattcataatctctttttcttccttctccttctgacaaattctgttctctgaaaaataaccctgttacattccagttgtggtaattgtaataattacacattataattcacttcccagaatggaatatgttaacttcagtaagttctcttaaatttcagtgtggaaaaaaatagatgatttttctgtaggatggacacaggcacagtctgatccctaatctcaaaactagacacaattgcattagcaattggtgagtaactgaagacttcacattgaagtcttggtttggtttttaatatttccatttcctttttttttgtaattgaactactttttgtaaattaatgggaagattgaaatactttgagaggagctattgggtttgcctctcagttttgctagtaactaagggaaaaagaataatgtggtttttcatggttgaaattgtgttttagtagagtccattgaaatatactttattatttggattattttcttattttccagttttaactgttttcagatggtacatgtaaagttaaagttttattcttggtgttaattttcagttggtaattataataattatacagctttcagaatatctcttcattctgaaagaaattctgaagagtaattctgaactcttcagttttttagtgtaacaaaatgaaagaaaatttactcaggaagggattgtgggttctttgttttcctttttttttcttccgtttttcttaatcttagaaatcatatttctttttctttcatagtcttttcttgtgtacgtgttttctttcactctattcattttttgctcagctatcctcctgtaacctcataacattcttaatgaagatgatgggatggtaagtgtctggcaaagcgggagataatatctttttccctcctgtattctactgaactcattgttccttctcagccttacttaatcaagttaaacttatacaccacagctctgcatttagtttcctgaccctgtgggttaggtagaatttagatacgaaaatggctggaaagatttataaaaatctattatgttaatcattggtggggaatccataacatggcatagaacttgaatgtatggatttgagaaaaaatatttacattaacttaattatatgatgatggatgctaattgataagcagtaggttgaaattcactgttacataattcactattatgtcatggttgctggttgcccttaactgaatgattttgaaggaaagctgataactattttgagttaaatttttacaagtggttccttatatggtgcaatgccgctgcaacaaacagtaggaattttgtagcaaaaagtcttaatagtatccatttaaataactgctgcttatttaatgcccatcagtgctaggcccccatctaaatgtgattgttacagtcattaattttcacaattctacaatggctttagaaagaggaaacaaaaatttaggttaaacgacttacctaacatgatttctctagtaagagataaaactgtgattcaaatctatgttagacatgtatctactgtaaccctgtattatttttttttaaccacatagttatcttttttttttttaatttggtgtttttccaaggttaaaaagaaattccagtgaagagttgattccatctttatggtatctttattttttaaggttataaggtatgttgatttatcaggaaagttaaatgaagaaatcttcaagaggccatttataattctgtttttaaaagtcaaaattgaaaagagttgggccaggtgcagtggctcacgcctgtaatcccagcattttcggaggccgggtgggtagatcacctgaggtgaggcgttggagaccagcctggccaacgtggtgaaaccctgtctttactaaagatacaaaaattagctgggcgtggtggcatgtgcctgtaatcctagctactcaggaggctgaggtaggagaatcgcttgaacctgggtggcagaggttgcagtgagccaagatggtgccatgcactccagcctgagcaacagagtgagactccatctcaaaaaaaaaaaaaaaaaaaattgatagagtttatactatttaatgtttaaatgttttctgtaaattaaacatcaatagacttgataatcatattttaggaacatttttttccattgaattatttacatatactgttgtactgtaaggctttaaattaattttaatattttattattttaattagcatttgaaatgtatagtgttcaataaatggattgctaaatta

SEQ ID NO: 158178 - DNA, 2917 bp, Homo sapiens
  Payload ID: 10970
  Gene Symbol: N4BP2L2
  Gene Name: NEDD4 binding protein 2-like 2
  ENST ID: ENST00000357505
  CDS Start-End: 199-2412
gtttacggagccggtgtgaacgtcggacttcaattcccacaatgcctggcgcaaacgcctagttttggcctgggtaaccgagaggtgaccgccatcttgcgtacggagaggttcgtgtcttcctaaaagaaggttttattgggaggtaaaggtcaatgcgtaggggtagagtaagaattctgcttggtcagaatcgtgatggcattgtgttcagcactgatgactattttcaccatcaagatgggtacagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggtaacaatttgaacattttattgtctaatttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatc

SEQ ID NO: 158179 - DNA, 2872 bp, Homo sapiens
  Payload ID: 10970
  Gene Symbol: N4BP2L2
  Gene Name: NEDD4 binding protein 2-like 2
  Uniprot ID: Q92802
  ENST ID: ENST00000399396
  CDS Start-End: 109-2367
gtttacggagccggtgtgaacgtcggacttcaattcccacaatgcctggcgcaaacgcctagttttggcctgggtaaccgagaggtgaccgccatcttgcgtacggagatgtcttatggtgaaattgaagaattctgcttggtcagaatcgtgatggcattgtgttcagcactgatgactattttcaccatcaagatgggtacagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggtaacaatttgaacattttattgtctaatttgaagatgtatgccatactttgtttgatagaagaaagtaaggcacagaaaacttgagtaccttatttttaaaactgcattaggattaaaaggttagcccctatatccaagtattggtctgagatcccatttctagaattctgaaatccaaaaagctctgaaaatcaatagttatttttccaaatgtattcattgtggtaaaatacaccaatataaaatttaccatcttaaccacttttaagtgtgttataaatacattcatgctaccatc

SEQ ID NO: 158180 - DNA, 2071 bp, Homo sapiens
  Payload ID: 10970
  Gene Symbol: N4BP2L2
  Gene Name: NEDD4 binding protein 2-like 2
  Uniprot ID: Q92802
  ENST ID: ENST00000446957
  CDS Start-End: 1-1968
atgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggat

SEQ ID NO: 158181 - DNA, 2343 bp, Homo sapiens
  Payload ID: 10970
  Gene Symbol: N4BP2L2
  Gene Name: NEDD4 binding protein 2-like 2
  ENST ID: ENST00000505213
  CDS Start-End: 217-2343
aaacgcctagttttggcctgggtaaccgagaggtgaccgccatcttgcgtacggaggtgaggtttgttaccgcgattctgagaggtgggcttttagtccctccagacctcggctttagtgctgtctccgcttttctttcaccttcacagaggttcgtgtcttcctaaaagaaggttttattgggaggtaaaggtcaatgcgtaggggtagagtaagatgtcttatggtgaaattgaaggtaaattcttgggacctagagaagaagtaacgagtgagccacgctgtaaaaaattgaagtcaaccacagagtcgtatgtttttcacaatcatagtaatgctgattttcacagaatccaagagaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagcttgaaaaggaaaaagatggttttgagaacagttgtaaagaatctgaaccttctcaggaacaatttgttccattttatgagggtcataataatggtctcttaaaacctgatgaagaaaagaaagatcttagtaataaagctatgccatcacattgtgattatcagcagaacttggggaatgagccagacaaatatccctgtaatggacaagtaatacctacattttgtgacacttcatttacttctttcaggcctgaatggcagtcagtatatccttttatagtgccctatggtccccctcttcccagtttgaactatcatttaaacattcagagattcagtggtccaccaaatccaccatcaaatattttccaagcccaagatgactctcagatacaaaatggatattatgtaaataattgtcatgttaactggaattgcatgacttttgatcagaacaatgaatatactgactgtagtgagaataggagtagtgttcatccctctggaaatggctgcagtatgcaagatcgatatgtgagtaatggtttctgtgaagtcagagaaagatgctggaaagatcattgtatggacaagcataatggaacagacaggtttgtgaaccagcagtttcaagaggaaaagttaaataaattgcagaagttacttattcttttaagaggtctgcctggttctgggaaaacaacattgtctcgaattctgcttggtcagaatcgtgatggcattgtgttcagcactgatgactattttcaccatcaagatgggtacaggtataatgttaatcaacttggtgatgcccatgactggaaccagaacagagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaa

SEQ ID NO: 158182 - DNA, 2513 bp, Homo sapiens
  Payload ID: 10970
  Gene Symbol: N4BP2L2
  Gene Name: NEDD4 binding protein 2-like 2
  ENST ID: ENST00000504114
  CDS Start-End: 93-2306
agaggttcgtgtcttcctaaaagaaggttttattgggaggtaaaggtcaatgcgtaggggtagagtaagaattctgcttggtcagaatcgtgatggcattgtgttcagcactgatgactattttcaccatcaagatgggtacagcaaaacaagctatcgatcagggaagatctccagttataatagataacactaatatacaagcttgggaaatgaagccatatgtggaagtggccataggaaaaggatacagagtagagtttcatgaacctgaaacttggtggaaatttgatcctgaagaattagaaaagaggaataaacatggtgtgtctcgaaagaagattgctcagatgttggatcgttatgaatatcaaatgtccatttctattgtaatgaattcagtggaaccatcacacaaaagcacacaaagacctcctcctccacaggggagacagagagaaagagttttgaagaaaactgggcataggctcagcaaaaccaaacagaagaggaacagaaaaagaaacaaaaagcagaacagtcagaatagaatcatggaggaaaactcattagaattcttaagtgatcttacaccgggagatcaggacccatctcagagtgaagaggaagacattgaaaagaccagaagagaatcagaatatcccttcattgatggtctacaaaatgaagtcggagattttgtgactggatataaagaaaaaagatggaaaaataaagatcctaaagacagtttccaaaacgttatgtctatagttgaattagacaacacaccaaagaattacctctctaaggaaggtgataacttgtttgtaagtttgttactgaggccaaatgaaatctccgttacttgtccaatactgactcaaaacctttcctgtgtaacaactgatgactgctctggcatgaaggtagaaaagcatattagaaataggcataccatagcattagacacccaggacctttctgcggaaacttcatgcttatttatgaagaagagagaaatagtagataaaaatctctcacatgaacccattctgtgccatcaacatggaatcagaatgtcagataaagttttaagagaggaacaagtgtatacaactaaaatcaatcactgggcttttttcacaaccaatttatctgatgaagatttacagctgggctctgacagacagccctattttggtagctggcctgcaggacctcataagtttatatgtgaacagagaccaaagaaagatagagcatgtaagttggctggtcctgacagcagggggcaatggattcaaatgatcttcacttcggtggcagcatcagaaccaggaaacaatccagaaatattgacagacaaactactgataggaaatgaagatttttcacctccacctgaaactatggattcattcatagaaacaaacctcttcagaagctgcttacctcaaccggatataccaaagaatgccttagaatcaacaaaaaataagaaaaggaggaagaaaaggattttcaatttggtaccaaattttgacttattaggacagagtcgtatcggtgtaaaagaaagggagaaatgtgacctgttaacaaaaaaccatggactaaaaattactttgggagaagaaaaagatagaatttcagaaaggaacagtgaagaggagaataaacaaaaacttatgacctttgatcatcatccattgtggttttaccttgatattatcaaagctacccctttaaatattgatggacagcgttattctcattgcctgtcatttaacagactaaggtgctctgcatctttatacaaaaattatattccttcttttgtgctacataatttatctagtatttggaagccatcttttacaaacaagaaactgtttttgactttcgaatctcagacaagagtaggtaataaactaaatgatgcagggtttatttctccagaaattttacatagtcatcctgatacttcgtgctctttgggagtcacttctgattttcactttttaaatgaaaggtttgatagaaagctgaaaagatgggaagaacctaaggaattaccagctgaggacagccaagacttaacaagcactgactaccgttcccttgagctaccattatcacaagggtttgcctttcaattagtaaagctttttggatctccaggcgttccaatggaatccttgttgcctgatgactatgtggttccccttgactggaagacactaaagatgatctacttgcaatggaagatgtcagtggagaaaagacagaagaagattggttgaaaaatgaaaattccttgaactttgagttctgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggaggt

SEQ ID NO: 158183 - DNA, 6080 bp, Homo sapiens
  Payload ID: 10971
  Gene Symbol: N4BP3
  Gene Name: NEDD4 binding protein 3
  Uniprot ID: O15049
  ENST ID: ENST00000274605
  CDS Start-End: 360-1994
ggttggctcgcgggtaggcggccccgccccccacatccgggggccggggccgggctgtgggcttgccgcgcgccggtgagtcaggccgggttttccctccgcctttggggcaggcgatcgagcgccgcggagcgcgtccctccctcgccaatccggctccggcgccggcgcccgcccgcgttttcccggcgcctgccgctccgccgctccgacccggcacgcagtcccggcccgagccgacgccttgcaggagggttcaaatccgcgcgggggagctgcgacgcgcaagggctgcggagccgcgggccggcgagcgcgtcgccaccatgaagcagctgcctgtaccctgttgaaacttcatggccacagccccaggccctgctggcattgccatgggcagcgtgggcagcctgttggaacggcaggacttctcccctgaagagctgcgggcggcacttgccgggtctcggggctcccgccagcctgatgggctcctccggaagggcttgggccagcgtgagttcctcagctacctgcacctccccaagaaggacagcaagagcaccaagaacaccaagcgggcccctcggaacgagcctgccgactatgccaccctctactaccgggaacattctcgcgcgggtgacttcagcaagacctcgctgccagaacggggtcgctttgacaagtgccgcattcgcccctcagtgttcaagcctacggcgggcaacgggaaaggcttcctatccatgcaaagtctggcgtcccacaaaggccagaagctgtggcgcagcaatggcagcctgcacacgctggcctgccacccgcccctgagccccgggccccgggccagccaggcccgggcacagctgctgcacgccctcagcctagatgagggcggccctgagcccgagcccagcctgtccgactcctccagtgggggtagttttggtcgcagtcctggtactggccctagccccttcagctcctcccttggccaccttaaccacctcgggggctccctggaccgggcctctcaaggacccaaggaggctgggccaccagctgtgctgagctgcctgcccgagccaccacccccctacgagttctcctgctcctctgccgaggaaatgggagccgtgctgcccgagacctgtgaggagctcaagaggggccttggcgatgaggacggctccaaccccttcacgcaggtgctggaggagcgccagcggctgtggctggctgagctgaagcgcctgtatgtggagcggctgcacgaggtgacccagaaggctgagcgcagcgagcgcaacctccagctgcagctgtttatggctcagcaggagcagcggcgcctgcgcaaggagctgcgggctcagcagggcctggctccggagcctcgggcccccggcaccctcccagaggctgaccccagtgcacgaccagaggaggaagcccgatgggaggtgtgccagaagacagcagagattagcctcttgaagcagcagctgcgtgaagcccaggcggaactggcccagaagctggcggagatcttcagtctgaagacacaacttcggggcagccgggcacaagcccaggctcaggacgcagagctggtccggctgcgcgaggctgtgcgcagcctgcaggagcaggcccctcgggaggaagccccaggcagctgtgagactgatgactgcaagagcaggggcctgctaggggaggcaggaggcagcgaggccagagacagtgctgagcagctgcgggctgagctgctgcaggagcgacttcggggccaggagcaggcgctgcgctttgagcaggagcggcggacttggcaggaggagaaggagcgcgtgctgcgctaccagcgggagatccagggagggtacatggacatgtaccgccgcaaccaggcactggagcaggaactgcgggcactgcgggagccccccacaccctggagtccccggctcgagtcctccaagatctgaggccagcagagcgagctgacagcagcaacactgtcagaaggtgccctgagacggccggctcagccttcccttgcactggttggggtggaacctgcagaggccagcccggggctggggaggcgcaaggagaggagggatccagtggggccgtgggctgggtagggtgccttggcaggagccaggacaaggccctcctggcagaggagcacctaggcagggcccagccctgcttcctggagtggatgtggcccagagaaggaggctgggggatcaccagccccaaggtcccgaagggcaggtcagagggagagaggctggagacctgggctggggccttcctccagggaaggaggctggggtgggaacactggcctcccccagaataaaaccatgttttctaccagaggctcagaatacgctgagcctgtgaccagaggatgatggatggtcgggattgaggctgttgacctgggcagtagctcctcccatggccagtggtcagtgggagggtgtgccctgcgcctgtctgcatggccactgggcatgtgtgttgggagcagaggagtcctactccttgcctcagccccacacggttccttagctgccgtgtgggctgaaattcctttctttagcaccagtggagttttcagaaggaacaacaccagggaatgccaaaaaaacaaagggcaagtcaaccaaggcattttgagaacatgaaatgtcttcttggtgggaaggctgggccccaggagtatccacaggctcaggccatgcccctccccgcacccacctcctgtctccctccctccctccataggagtggggggcccctagaagtgctctgcctcattccctgttcgtaggaaggtgcaggagaggaggtgggcaagcttatgggtttcttggtaaagagcctttaccacagcaaggaatgggaacatttccccatcagcaacggggctctagggcattattaagtaggggtgaaatatgattgatttgcattctggaaagctctcccaggaggaagcattccccaccccaccttgcctctgtcctgcgctgggctccaggacggtcagtcctcccggatccctgctctcagctaaggctggtccctaaaacccacacctgcctttggtctctcagaggcctggcttgccctctgggcctttgctcccccgctgggtgcccggcctggaacacaggttctgtctggctgtgtgagtggcgtctctcccttcctttgagggaagctcagctttcttacgcgctcatcgttggacgggctgccatgcattgcgtgcttactgggcgccaggtgctgtgctgggcccttgtgagtgtgggggcacaggctgaattagatgagctcctgccgcagggggccctgcacactgatgtcagctcaccagtctcttccctgacagggcagctcagggaacttctgagaagttatctgcagagagccccacctcactccctttggctaccctggccgtgcctggcagcccctcaggccccacaggtgggtcctggttgtgaagtggagttagtgcacatggatgtcaggggacgggtgtgaggcatgagctgggggggccccctttttcagggcagagaatgaggcgtgtgcactgtctgctgtggggatggtgtgtttatggccatgtaagtggcaggtgtgtgtaaagatgtgcttgtgggtggtgggtgtgtctgagggggtgtgtttgggagcctggcctccaaaagccagtgtctgggttggagacagtgcaggccccttcttggccccaccctctaccccattccttcctgtcagccccagtctgtcttggcactggccaggcttgggtggagcctgtgtcccagacagatcccctaggcctatctgagacccatacaggcccacacctgagctcctgtctgcctgaggagggaaagggggagtggccaggtcaggcaggccagtcgtctacacacccccttggtacccattcccatttcacaaactcctccaaaccccaaaccccaaacggaaatctctgggacaatggctcctccagagggcccctcagagccaggtgctggccagatgccttgatcacagcctccatggccaggggcctgtcaagccaggggcccacacacctggtgccagggtccaccttggtataccagctcggcagaacagttccccacccagcgattagggagctgggctggccagtacagccagtggggagtgggtgggaggcaccaaaacttggcagctgtgccagaaaccaaagccaggcccagatgtagggggagggcacgagagctgaacctgagcctggggcgtctcggagctggatccccgtcagctcatccaggctggacaaaccagttcctgggtcccccagccggctgggtggctctggggccaaccgaccacaggtgtcactgatcacaggtgtcaccgtagtggctaccacctcagggcagcccctccctccagctggcggggcctcagcttcccagctgccctggcttagccttccctgcagcccctccccaacaggcttggtccgggcagcctgctctgcggaaggtggcagcctcctggtgctgggctccctgcctctggggcctccagtccttcactcagtgtcatcccttccagcagctccctgggcctcttggtccatcccttcaggcttctgacacactagtggcctcgagtcactgatagtggtgcctcctccttaccttggcaagcccttgtagccctctgagccctcatcctgcaggcagagcccctcagtgctctgagaaacctgccctgaactcaccgcctcccctgcctgggcactccctcctccctgcgcccacagcccccatgccaatctccgtcagctctttctgtgctgctgtaattgttggtttgcctgtctcctttgagctgtgggcattgccggggtagggtggtgtcttcaccacagctccagaaggcactggtgggatgtggagtcaggagcaaccagagaccccccaatactagaatgggtttgagcttggggtggggtggatggggaagacttactctgaatgttcgttcaccatccgtgggcaccaggtctgtgccaagcacagggactccaggggcagctgccattcgttccagtgatgtatttggggccttctcaggtgaggaagccaaggtggccaaggccctcggtcccctgccctgatagggcttacctgtgggtgggggagggagaccacacatgtcagaggtagtgaaggccgctccaaatagtgactggggccaggcaggcggaaaagagaacagaagagaatccagaagtgttcagacagaactagggacaacagaggggcctccatggtggcatgggtcagcagagcatggagcaggcagaggaagcctatctgtggggctgggtacatttctctgagactcacggaatgtaagtgttgaggtttctgcaaagagggcgcaggccctgcagtgacggttcagatattgataacccatcccccttggcaggtgggggcttaggcatccatattggattcagaaaagaaaaagaatgatgcttcttgcaacaaaaacaaaagtgattatgtcacgagaggagaggctggagggccatgggagttcccagctggctcactcatccgtccaggaggtgggtctcatggtttcattttgctttgggcttacttagagttttggcaaatgcagagttatgtaacgaacccaacaatgaagatacagttctgtcacccccccagcattctcctgtggccctctagtccaccccccgccccaccccagcccctggcaaccactgatctgctttcacaataaccgtatggggttttttctctttccttttttgtgagcggtatttaattcctttgctctaatatgtaatattagaacatattacaaagtagcaagaaaaatacgacattggtgtaaaaataatctacacctcatggaaagaatgaagagccagaaatagattctattctgtagaaaatcttacacaataaaggacttcaaaataagggtaa

SEQ ID NO: 158184 - DNA, 3851 bp, Homo sapiens
  Payload ID: 10972
  Gene Symbol: NDFIP1
  Gene Name: Nedd4 family interacting protein 1
  Uniprot ID: Q9BT67
  ENST ID: ENST00000253814
  CDS Start-End: 471-1136
gggcacgtaggtgaagctcagtgcttggcacgaggtgctcatcagcagcatcgcccttgctttgggctggcctgttagtaattcgtttttagtggaatcgaatacaacacttgagcctcggaggctcaggtcgtcggagcaactacaccagggccggtgcacctcggggcggcggcgcaggactaggctaggccgggccgggccgggcagggcggcgcgagtcgggggtggggcggcggcgcagcgccgtcgtcgtagtccccgcctcttccccaggggccgcgtcggagcctcggcggcggcggcggtgcttacagcctgagaagagcgtctcgcccgggagcggcggcggccatcgagacccacccaaggcgcgtccccctcggcctcccagcgctcccaagccgcagcggccgcgccccttcagctagctcgctcgctcgctctgcttccctgctgccggctgcgccatggcgttggcgttggcggcgctggcggcggtcgagccggcctgcggcagccggtaccagcagttgcagaatgaagaagagtctggagaacctgaacaggctgcaggtgatgctcctccaccttacagcagcatttctgcagagagcgcagcatattttgactacaaggatgagtctgggtttccaaagcccccatcttacaatgtagctacaacactgcccagttatgatgaagcggagaggaccaaggctgaagctactatccctttggttcctgggagagatgaggattttgtgggtcgggatgattttgatgatgctgaccagctgaggataggaaatgatgggattttcatgttaacttttttcatggcattcctctttaactggattgggtttttcctgtctttttgcctgaccacttcagctgcaggaaggtatggggccatttcaggatttggtctctctctaattaaatggatcctgattgtcaggttttccacctatttccctggatattttgatggtcagtactggctctggtgggtgttccttgttttaggctttctcctgtttctcagaggatttatcaattatgcaaaagttcggaagatgccagaaactttctcaaatctccccaggaccagagttctctttatttattaaagatgttttctggcaaaggccttcctgcatttatgaattctctctcaagaagcaagagaacacctgcaggaagtgaatcaagatgcagaacacagaggaataatcacctgctttaaaaaaataaagtactgttgaaaagatcatttctctctatttgttcctaggtgtaaaattttaatagttaatgcagaattctgtaatcattgaatcattagtggttaatgtttgaaaaagctcttgcaatcaagtctgtgatgtattaataatgccttatatattgtttgtagtcattttaagtagcatgagccatgtccctgtagtcggtagggggcagtcttgctttattcatcctccatctcaaaatgaacttggaattaaatattgtaagatatgtataatgctggccattttaaaggggttttctcaaaagttaaacttttgctatgactgtgtttttgcacataatccatatttgctgttcaagttaatctagaaatttattcaattctgtatgaacacctggaagcaaaatcatagtgcaaaaatacatttaaggtgtggtcaaaaataagtctttaattggtaaataataagcattaattttttatagcctgtattcacaattctgcggtaccttattgtacctaagggattctaaaggtgttgtcactgtataaaacagaaagcactaggatacaaatgaagcttaattactaaaatgtaattcttgacactctttctataattagcgttcttcacccccacccccacccccaccccccttattttccttttgtctcctggtgattaggccaaagtctgggagtaaggagaggattaggtacttaggagcaaagaaagaagtagcttggaacttttgagatgatccctaacatactgtactacttgcttttacaatgtgttagcagaaaccagtgggttataatgtagaatgatgtgctttctgcccaagtggtaattcatcttggtttgctatgttaaaactgtaaatacaacagaacattaataaatatctcttgtgtagcaccttttactgtagattagtgcttaatttcttggcttgcatttgttgattgctaaggcaattttttctaatcttagggaatcattcagtagatgcgattaaaaaactaatgttgggtcaatttttttcttcattttcagcacaagaagtcctcttatatcctactaaatacattcctaaaaatgtatttgaacattggttctgtaaaagataatggactaaaaaagtagagaggagttgtagagatcttaaatcattctggaattcctaattatgcttcaatttttagacataattttagataatttatttccagtgttttctgcatgttctcatttgttctttttctcagttgaatgcaccaactggtttgagtcctgtgagcattcagtcagttgaaattaaagattcctcatttctcctgatttctattcttgtctcaatcttaaatttagagaccagttgtttttatgatatcagccatttgatttttttcattttctatttaagaaatatgaagaaaaaatacaccaagatggtcaaattactacacaaatcagcaccagcacagtctgatagctgcaaatgtccattcatctgctgtgtatgtatatccagaatcagcataggaagtcgttcaggatatcagtatataatgcacagaagtgtgggttgtttgaaagccaaacaggaaaattaggagcctcctggattgacatttcaatgatccctctaaccagtttatggattattatgaataatagtgtagtgtgttctttttcagaagttatatttgataatagagaagggagttttatggaagtttctttgaagatttttttttttccatttcgaatcagattatagcaacaatggagtttggaagtttgtatggcctataatgttctaagttccagaatgaaaagatctgtaacaatctgaatagatgtggacacatatagcagagagaactatgtaaattatcttgcagaacaaaatagaagggtcctaaatcacgttaactcaaacattgtagactagctttgtgtttattcttcaggtccttgcgccttatttggttttgtatattcaacgaactgaaatatttggaattcctatttctacgtatttggtggtccataagactttgtcaaatgtaaacctacagtttgatacgctttaaaatacctagttaagaggatgatttctctttaatcgtttaaatgttctgaaaattaaaatcttttgaggcacatgaagtgggcaccatatatcatctagagtccttactggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgttaaaaaatgataa

SEQ ID NO: 158185 - DNA, 4625 bp, Homo sapiens
  Payload ID: 10973
  Gene Symbol: NDFIP2
  Gene Name: Nedd4 family interacting protein 2
  Uniprot ID: Q9NV92
  ENST ID: ENST00000218652
  CDS Start-End: 53-1063
cttacttttccatctcctcccacccagctataccctcccactggcggcgcggatggcacgccggcggagccagcgagtctgcgcgagcggtccgagcatgctcaatagcgcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttattttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcctattttttgttttgtctcattcagtttactttcctgcgtagaatttttattgttatattaaaatttttattgttgtattaaagtacctgtgttacaccccttgaagtaagacagtagcatggggtaaagaaaaaatatttagtttagttgcctaatttggaagttaattaaaattaaactgtactaataacatattcaaactcatgctggatctctttcatattaatttcttatagacctgtactttattctttcaataatttttaaatgaaattaagctttgctacatggtaattaaataattactaggaagcttagctatcaaacatcgacttactaaaatttcattttagcttttatggtatatgtgcttgttttctgaatatggatacatgttacttttgatccagcatcaaaacttcactttttgttttgacttttccccccaaatctgtaaggttcaagtatacatattactgaatcctctataattggcataattcaatggtagccttaaatctcatcatgtaagcaggggaatcagaatgttattttcaagaacttaatgttcccttcagatatataaaatcctgcatacttcatttcctgtgagcttgaacagctgctgttgtgttttggggatgcttgatcatctttgcactctgccttaaagattgaaaaatcaaaactcttgttagggtatctaaacatttttgagtgtgaactggggattggaagttaatacaaaaaaatttcaaattatttctattgtaaatgaataagctagtcatggctaggataatccattttcatgtatttatgcaataaactgaattttaaggcaaaaacaacacttttctatatagtgtatgcaggacagattttagaaacttagattaaaatacaaatcccattacatttggttaaaatgaaaatctctgcttaatggaaaaaatactaatctttagcctattttgagtctataagatatatttcattttagacatgccttctaagttgttcacagatttttacctgctaaaacaatattatttccagtaaaacctctcctaacaggaaaagtggagttcaaaatatccaattggagaaaaattcagagttccttcattaaatataatttttttcatctagtatgtactatttcaagaagtgcaaaaagtaatgatagtgaatgtgataccatacttaactaaggtaatatatatccttagtttgctcaaaagagtcctggttattcctgttttctcagcttaatagtgcctcatcgtactctcaaaagtgttctaatttggaggataagttatatgatcatcctgtgtataattgtagactgtaccaagaagcaactaccttagctccactgccctttgagggatggaactggggtaagggcaggagccagttattattgccacagtgttttctaatgaaccatttggcctgtagaagaggaatagtattttttttaatagttgtatttgaatgattccagcttatcgtaaatactaaactgaatggcttttatatttttaactgctgttaaatgttattttagcatttattagttgtttattatttaattcttcaaatagtcatatgaaaacatatatttgataaaggtcaattgttagatgataatgtgccattcattatcataggaatgtccttgcccatatataaaacatgctggcatgtattttacttgttaataaagttgtatagatgtggaagtgtgaacctgtgatgcatccttttcaaaatcagtttaagattcgcatattatcatgactgtgacctcactaaactgtttatgtgacaaacctttcaagattggagatgaaaacaacacttgtgaaattaggttggggttgcaacatcttttaacttctcagttatttgtatgtcaggagacagattgtggtttaattttaataaacaaaatatcatctttttgaaaat

SEQ ID NO: 158186 - DNA, 1384 bp, Homo sapiens
  Payload ID: 10973
  Gene Symbol: NDFIP2
  Gene Name: Nedd4 family interacting protein 2
  ENST ID: ENST00000487865
  CDS Start-End: 34-702
ctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcactggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtat

SEQ ID NO: 158187 - DNA, 698 bp, Homo sapiens
  Payload ID: 10973
  Gene Symbol: NDFIP2
  Gene Name: Nedd4 family interacting protein 2
  ENST ID: ENST00000465762
  CDS Start-End: 30-470
ctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcattttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacct

SEQ ID NO: 158188 - DNA, 4648 bp, Homo sapiens
  Payload ID: 10973
  Gene Symbol: NDFIP2
  Gene Name: Nedd4 family interacting protein 2
  Uniprot ID: Q9NV92
  ENST ID: ENST00000612570
  CDS Start-End: 81-1091
acaacctagacagctcccccggacttgccttacttttccatctcctcccacccagctataccctcccactggcggcgcggatggcacgccggcggagccagcgagtctgcgcgagcggtccgagcatgctcaatagcgcgcgcggcgccccggagcttctccgcggaaccgcgaccaacgcggaggtctcggcggccgctgcgggagccacaggaagtgaagagcttccgccgggagaccgcggctgcaggaacggaggcggaaggggccctgcggcgacgacgtcgtcgacgggggtggccgtgggagctgagcacggagaagactccctctctcggaagccggatcccgagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttattttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcctattttttgttttgtctcattcagtttactttcctgcgtagaatttttattgttatattaaaatttttattgttgtattaaagtacctgtgttacaccccttgaagtaagacagtagcatggggtaaagaaaaaatatttagtttagttgcctaatttggaagttaattaaaattaaactgtactaataacatattcaaactcatgctggatctctttcatattaatttcttatagacctgtactttattctttcaataatttttaaatgaaattaagctttgctacatggtaattaaataattactaggaagcttagctatcaaacatcgacttactaaaatttcattttagcttttatggtatatgtgcttgttttctgaatatggatacatgttacttttgatccagcatcaaaacttcactttttgttttgacttttccccccaaatctgtaaggttcaagtatacatattactgaatcctctataattggcataattcaatggtagccttaaatctcatcatgtaagcaggggaatcagaatgttattttcaagaacttaatgttcccttcagatatataaaatcctgcatacttcatttcctgtgagcttgaacagctgctgttgtgttttggggatgcttgatcatctttgcactctgccttaaagattgaaaaatcaaaactcttgttagggtatctaaacatttttgagtgtgaactggggattggaagttaatacaaaaaaatttcaaattatttctattgtaaatgaataagctagtcatggctaggataatccattttcatgtatttatgcaataaactgaattttaaggcaaaaacaacacttttctatatagtgtatgcaggacagattttagaaacttagattaaaatacaaatcccattacatttggttaaaatgaaaatctctgcttaatggaaaaaatactaatctttagcctattttgagtctataagatatatttcattttagacatgccttctaagttgttcacagatttttacctgctaaaacaatattatttccagtaaaacctctcctaacaggaaaagtggagttcaaaatatccaattggagaaaaattcagagttccttcattaaatataatttttttcatctagtatgtactatttcaagaagtgcaaaaagtaatgatagtgaatgtgataccatacttaactaaggtaatatatatccttagtttgctcaaaagagtcctggttattcctgttttctcagcttaatagtgcctcatcgtactctcaaaagtgttctaatttggaggataagttatatgatcatcctgtgtataattgtagactgtaccaagaagcaactaccttagctccactgccctttgagggatggaactggggtaagggcaggagccagttattattgccacagtgttttctaatgaaccatttggcctgtagaagaggaatagtattttttttaatagttgtatttgaatgattccagcttatcgtaaatactaaactgaatggcttttatatttttaactgctgttaaatgttattttagcatttattagttgtttattatttaattcttcaaatagtcatatgaaaacatatatttgataaaggtcaattgttagatgataatgtgccattcattatcataggaatgtccttgcccatatataaaacatgctggcatgtattttacttgttaataaagttgtatagatgtggaagtgtgaacctgtgatgcatccttttcaaaatcagtttaagattcgcatattatcatgactgtgacctcactaaactgtttatgtgacaaacctttcaagattggagatgaaaacaacacttgtgaaattaggttggggttgcaacatcttttaacttctcagttatttgtatgtcaggagacagattgtggtttaattttaataaacaaaatatcatctttttg

SEQ ID NO: 158189 - DNA, 2324 bp, Homo sapiens
  Payload ID: 10973
  Gene Symbol: NDFIP2
  Gene Name: Nedd4 family interacting protein 2
  ENST ID: ENST00000620924
  CDS Start-End: 13-741
gagccgggcaggatggatcaccaccagccggggactgggcgctaccaggtgcttcttaatgaagaggataactcagaatcatcggctatagagcagccacctacttcaaacccagcaccgcagattgtgcaggctgcgtcttcagcaccagcacttgaaactgactcttcccctccaccatatagtagtattactgtggaagtacctacaacttcagatacagaagtttacggtgagttttatcccgtgccacctccctatagcgttgctacctctcttcctacatacgatgaagctgagaaggctaaagctgctgcaatggcagctgcagcagcagaaacatctcaaagaattcaggaggaagagtgtccaccaagagatgacttcagtgatgcagaccagctcagagtggggaatgatggcattttcatgctggcatttttcatggcatttattttcaactggcttggattttgtttatccttctgtatcaccaataccatagctggaaggtatggtgctatctgcggatttggcctttccttgatcaaatggatccttattgtcaggttttctgattattttactggatatttcaatggacagtattggctttggtggatatttcttgtacttggcctgctccttttcttcagaggatttgttaattatctaaaagtcagaaacatgtctgaaagtatggcagctgctcatagaacaaggtatttcttcttattgtagagactgcatcaacccgacattcctttcttataccaatgtgaaatttccagatcatctgtaaacctacaactttaatagaagactactaataacagaagacaaattagtgaagaaaagacggagtttcgaaattgaatggcagggtggtttttgcttacaagccatttctgttcattctttaagtatctatatttcatttgttttgcacatatgcatatgtgcccatttaagatatttgcatatacttgatagaaaccataaagttgtagcagttaagtccagtcacatttggttaatcagtgtttgatataattgaaagagttgagtggataaacagtcttccagcttgtaaatgccattgacttctgacctgacatttagtataataaaaatgaaattcttaaccatgtcaaatgatttagtttctggctcttagactcatctggcagttctacacatgaaacatcttttgttatataaggtgtattgaaacctgcagtgctgattattagaaaggatttgtcagatttttgaacatgatatttacattattatttaggaaaactcttcctgtaaataaccatgcataacttactttctgcaatgttttcttagaaattgtgtccagatagctttcactaattttaaattaagtgaactaaatatatatgtgtatatgtatacacatatatatacacacacacatatatatatttagaaacgtgagtgttaaagatagaatttgttttaggacaaattttaagaaaatgtgggaataccaaatgtcctttataagaaaaataaattttattttaagggacatactagttttagggattttcagatgggaagctgcatttttaggattgcccatcttaagagatcttgcaggaagagattgtattagatattatatttatttcatttaagataattttcaaagttaattttctaaataagataattctcatttgtgtttgtcttttaaaaggccaataaaatatctttcagtatcattgtaataattttttagagtttaatttgtaaagcttagcaaataaaatcttgtactatgaatagcttcttgctttatgactttaggattaacttgtaaaaaacatatcctgaactgagatatgcaaaatactcattttcaagttatggaaatgtgtttgtggcatataggactgtggggtctgtgtgtgtagtgagagtgtgtagccactattataactggaatttaatttacattcataaactactatatttcccatcttgcaaatcattttatgtctcatctgtttttcctttcggttatatctttggttttgaataccaacatttaaaatgatggtattttatcttttaaacttaaaaattatttaatacagctatatggaccttataaaattgatttcttatttattattagacattactactaaaaggtacatctaactattcagggacatttttccatttccaaaaaataaaatttattatgctttataacctcttctgtattttctaattttttcattgtctttgataaataaaacagttttgttttgctaatatagcct

SEQ ID NO: 158190 - DNA, 1837 bp, Homo sapiens
  Payload ID: 10974
  Gene Symbol: NAE1
  Gene Name: NEDD8 activating enzyme E1 subunit 1
  Uniprot ID: Q13564
  ENST ID: ENST00000290810
  CDS Start-End: 99-1703
ggtagcggcgaaggggcgctcagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaataa

SEQ ID NO: 158191 - DNA, 1825 bp, Homo sapiens
  Payload ID: 10974
  Gene Symbol: NAE1
  Gene Name: NEDD8 activating enzyme E1 subunit 1
  Uniprot ID: Q13564
  ENST ID: ENST00000359087
  CDS Start-End: 78-1691
agtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtaacgtaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaataa

SEQ ID NO: 158192 - DNA, 1909 bp, Homo sapiens
  Payload ID: 10974
  Gene Symbol: NAE1
  Gene Name: NEDD8 activating enzyme E1 subunit 1
  Uniprot ID: Q13564
  ENST ID: ENST00000379463
  CDS Start-End: 194-1780
agtgcgcctgcgcgcttgtggagctggtggcggcgctccgcaggggctcggctgttttccgcgcggcaggcgcggccatggcgcagctgggaaagctgctcaaggagcagaagtacgaccggcagctgaggcgattcctccatacatttgacagctgtctgggcccttatggagcatacagtggagtggaaagatggatgctcagcaaacaaaaacaaatgaagccaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgt

SEQ ID NO: 158193 - DNA, 1654 bp, Homo sapiens
  Payload ID: 10974
  Gene Symbol: NAE1
  Gene Name: NEDD8 activating enzyme E1 subunit 1
  Uniprot ID: Q13564
  ENST ID: ENST00000394074
  CDS Start-End: 220-1557
agctggtggcggcgctccgcaggggctcggctgttttccgcgcggcaggcgcggccatggcgcagctgggaaagctgctcaaggagcagaagtacgaccggcagctgaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggctccagaagatgaagagaattttgaagaagctattaaaaatgtgaacacagcactaaatacaactcagatcccaagcagtattgaagatatatttaatgatgatcgctgcataaatatcaccaaacagactccatcattttggattttagctcgtgccttaaaggaatttgtggccaaagagggtcaaggaaatttacctgttcgaggcacaattcctgatatgattgcagattcaggcaaatatataaaactgcaaaacgtttaccgtgaaaaagcaaagaaagatgctgccgctgtgggtaatcatgttgccaaattgctgcagtccattggccaggcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaa

SEQ ID NO: 158194 - DNA, 566 bp, Homo sapiens
  Payload ID: 10974
  Gene Symbol: NAE1
  Gene Name: NEDD8 activating enzyme E1 subunit 1
  ENST ID: ENST00000563253
  CDS Start-End: 61-132
gtggagctggtggcggcgctccgcaggggctcggctgttttccgcgcggcaggcgcggccatggcgcagctgggaaagctgctcaaggagcagaagtacgaccggcagctgagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaaacaaatggacgaatacctaaaacgtataaagaaaaagaggacttcagagatttgattagacaaggaattctaaaaaatgaaaatggggct

SEQ ID NO: 158195 - DNA, 401 bp, Homo sapiens
  Payload ID: 10974
  Gene Symbol: NAE1
  Gene Name: NEDD8 activating enzyme E1 subunit 1
  ENST ID: ENST00000563185
  CDS Start-End: 75-401
gcgcctgcgcgcttgtggagctggtggcggcgctccgcaggggctcggctgttttccgcgcggcaggcgcggccatggcgcagctgggaaagctgctcaaggagcagaagtacgaccggcagctgagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtgg

SEQ ID NO: 158196 - DNA, 1460 bp, Homo sapiens
  Payload ID: 10974
  Gene Symbol: NAE1
  Gene Name: NEDD8 activating enzyme E1 subunit 1
  ENST ID: ENST00000567743
  CDS Start-End: 70-147
tgcgcgcttgtggagctggtggcggcgctccgcaggggctcggctgttttccgcgcggcaggcgcggccatggcgcagctgggaaagctgctcaaggagcagaagtacgaccggcagctgaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactccatggattgtgatcatagctaaatatttagcacagtggtatagtgaagtatgtccttttttaaaaaaaatttcatatgcaactgtattttcagtttcttacaaaggatttccttgatggggaatgggagattaattttttttccttatggagttgtatggtagggcaaatggatgcttttaaatttaaatctagcagttcctcttttgatcctgataattttaattaaaatgaaattcaataaatgtcattatgaaactggcagggggaatgaatgtagataaatggtcacagtgtctgttttctatcaagtgagcctctgatttcacagagaaatatatttgttgatgaaatcttatgtagagaatgggggacactttagactttcaatttctgtattttgaattttaataactagatttttaaaatttttaaccaatttagacaaatggacgaatacctaaaacgtataaagaaaaagaggacttcagagatttgattagacaaggtaatatgggatatgattaaatactgtataaagcttgaaaagcaaattgctagaggcaggtacttattggatttctgttaacacctttgtcagatgatagcatcatgagcttttattttccttctggagaagttaagaagccacgccttgtatagttttaaggactaatgataagccgtatttcttcttaagatttaatattctgcaggatctgacaaggttatttttataatgggggaacagaagagtgaaaagaaaagggctgtttgctaacaatttcccattacaataggaattctaaaaaatgaaaatggggctccagaagatgaagagaattttgaagaagctatt

SEQ ID NO: 158197 - DNA, 580 bp, Homo sapiens
  Payload ID: 10974
  Gene Symbol: NAE1
  Gene Name: NEDD8 activating enzyme E1 subunit 1
  ENST ID: ENST00000565535
  CDS Start-End: 78-580
agtgcgcctgcgcgcttgtggagctggtggcggcgctccgcaggggctcggctgttttccgcgcggcaggcgcggccatggcgcagctgggaaagctgctcaaggagcagaagtacgaccggcagctgagacggagtctcgctctgtcgcccaggctggagtgcagtggcgcaatctcggctcacttcaagctccgcctcctgggttcacgccattcttctgcctcagcctccgagttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctga

SEQ ID NO: 158198 - DNA, 567 bp, Homo sapiens
  Payload ID: 10974
  Gene Symbol: NAE1
  Gene Name: NEDD8 activating enzyme E1 subunit 1
  ENST ID: ENST00000569348
  CDS Start-End: 78-272
agtgcgcctgcgcgcttgtggagctggtggcggcgctccgcaggggctcggctgttttccgcgcggcaggcgcggccatggcgcagctgggaaagctgctcaaggagcagaagtacgaccggcagctgaggcgattcctccatacatttgacagctgtctgggcccttatggagcatacagtggagtggaaagatggatgctcagcaaacaaaaacaaatgaagccaggtacagtggcttgtgcctgtagtcccagcaactctagaggctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatga

SEQ ID NO: 158199 - DNA, 562 bp, Homo sapiens
  Payload ID: 10974
  Gene Symbol: NAE1
  Gene Name: NEDD8 activating enzyme E1 subunit 1
  ENST ID: ENST00000569388
  CDS Start-End: 79-336
cagtgcgcctgcgcgcttgtggagctggtggcggcgctccgcaggggctcggctgttttccgcgcggcaggcgcggccatggcgcagctgggaaagctgctcaaggagcagaagtacgaccggcagctgaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaaaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccaggtaa

SEQ ID NO: 158200 - DNA, 686 bp, Homo sapiens
  Payload ID: 10974
  Gene Symbol: NAE1
  Gene Name: NEDD8 activating enzyme E1 subunit 1
  ENST ID: ENST00000566336
  CDS Start-End: 200-686
cgcgcggcaggcgcggccatggcgcagctgggaaagctgctcaaggagcagaagtacgaccggcagctgaggtgtcttctacgtgccatactttgatggagaaaacaggcgtttacggtccatctggttcttctaggcgattcctccatacatttgacagctgtctgggcccttatggagcatacagtggagtggaaagatggatgctcagcaaacaaaaacaaatgaagccaggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaac

SEQ ID NO: 158201 - DNA, 576 bp, Homo sapiens
  Payload ID: 10974
  Gene Symbol: NAE1
  Gene Name: NEDD8 activating enzyme E1 subunit 1
  ENST ID: ENST00000566663
  CDS Start-End: 1-390
gcaccagagtccatttcagagaaagaattaaaattactctgcagcaattctgcatttcttcgagtggtaagatgtcgatccttagctgaagaatatggtttggatacaattaacaaggatgaaattatttctagcatggacaatccagataatgaaatagtgttgtacttaatgttacgggctgttgatagatttcataaacaacagggtagatatccaggagtatctaactatcaagttgaagaagatataggaaagttgaagtcttgtctcactggcttccttcaggaatatggtttatctgtaatggtgaaagatgattatgtccacgaattgagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaa

SEQ ID NO: 158202 - DNA, 473 bp, Homo sapiens
  Payload ID: 10974
  Gene Symbol: NAE1
  Gene Name: NEDD8 activating enzyme E1 subunit 1
  ENST ID: ENST00000562428
  CDS Start-End: 1-339
tttcataaacaacagggtagatatccaggagtatctaactatcaagttgaagaagatataggaaagttgaagtcttgtctcactggcttccttcaggaatatggtttatctgtaatggtgaaagatgattatgtccacgaattgctaatcaaaattcatgtctctgtggtctcctttagttgccgatatggagctgctgagccacataccattgctgcattcttggggggagctgctgctcaagaggtcatcaaaataatcaccaaacaatttgtaatttttaataatacttacatttacagtggcatgtcacaaacttcagcaactttccagttgtagagtaagcaagcaccttaagtagtgtgttaatgattgaaactgtaattgccttcgggttgtgctttagtctgtaaaattctaaaggagagctgctaaattgttttcttaataaacatttttctcatttgtaataa

SEQ ID NO: 158203 - DNA, 728 bp, Homo sapiens
  Payload ID: 10974
  Gene Symbol: NAE1
  Gene Name: NEDD8 activating enzyme E1 subunit 1
  ENST ID: ENST00000561579
  CDS Start-End: 357-728
cgcagagtcggctgcgtcagcaggcaatggccttggagcaccggcctgagctacccagggagacggtggatctccaggaaaccgcgagtgcctaggagcccctccccaccttttccggggaagccctggtcggagcgagccggttgtggggtgatcatgggcaagaggctttagaatctgctcatgtttgcctaataaatgcaacagccacaggaactgaaattcttaaaaacttggtactaccaggtattggttcgtttacaattattgatggaaatcaggtcagcggagaagatgctggaaacaatttcttccttcaaagaagcagtatcggcaagaaccgagctgaagctgccatggaattcttacaagaattaaatagcgatgtctctggaagttttgtggaagagagtccagaaaaccttctagacaatgatccctcatttttctgtaggtttactgttgtagttgcaactcagcttcctgaaagcacttcactacgcttagcagatgtcctctggaattcccagattcctcttttgatctgtaggacatatggactagttggttatatgaggatcattataaaagaacatccagtaatagaatctcatccagataatgcattagaggatctacgactagataagccatttcctgaactgagagaacattttcagtcctatgatttggatcatatggaaaaaaaggaccacagtcatactcca

SEQ ID NO: 158204 - DNA, 595 bp, Homo sapiens
  Payload ID: 10975
  Gene Symbol: NEDD8-MDP1
  Gene Name: NEDD8-MDP1 readthrough
  ENST ID: ENST00000534348
  CDS Start-End: 86-595
aggcaagagtgctggagggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagattgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaaggg

SEQ ID NO: 158205 - DNA, 471 bp, Homo sapiens
  Payload ID: 10975
  Gene Symbol: NEDD8-MDP1
  Gene Name: NEDD8-MDP1 readthrough
  ENST ID: ENST00000530579
  CDS Start-End: 19-222
ccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatattacactctctggcctttctgggtcgacacgcacgtagaccctccgttccataagagcagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcc

SEQ ID NO: 158206 - DNA, 758 bp, Homo sapiens
  Payload ID: 10975
  Gene Symbol: NEDD8-MDP1
  Gene Name: NEDD8-MDP1 readthrough
  ENST ID: ENST00000605847
  CDS Start-End: 70-324
gggcggcagcggcgaccggagcggtaggagcagcaatttatccgtgtgcagccccaaactggaaagaagatgctaattaaagtgaagacgctgaccggaaaggagattgagattgacattgaacctacagacaaggtggagcgaatcaaggagcgtgtggaggagaaagagggaatccccccacaacagcagaggctcatctacagtggcaagcagatgaatgatgagaagacagcagctgattacaagattttagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtactttgttcatcgggaaatctatccaggcagcaagatcacacactttgagaggttgcagcagaagactggaattcctttctcccagatgatcttctttgatgatgagaggcggaatattgtagacgtcagcaaactgggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgaca

SEQ ID NO: 158207 - DNA, 2228 bp, Homo sapiens
  Payload ID: 10976
  Gene Symbol: NELFA
  Gene Name: negative elongation factor complex member A
  ENST ID: ENST00000333877
  CDS Start-End: 225-485
ggctctcggctttgccacaaagcttcccgaagacgcggccgctacccggagacgcggtcgccacccagaagcgctctcccgggaagccccgctcgtgggaccgcgccacctgcgccgcctctgcggcccgcagcccgacgggcgccgccatgttggggtcctagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttct

SEQ ID NO: 158208 - DNA, 3343 bp, Homo sapiens
  Payload ID: 10976
  Gene Symbol: NELFA
  Gene Name: negative elongation factor complex member A
  ENST ID: ENST00000382882
  CDS Start-End: 1119-2738
gtgacttccgcaggactgccaagttcaagccgccagggccagggcactgctagcagctgggctgagccctgttctcccggcgttcccaccgcccagtggcaatagctgtgaacggcggcaggagcatggcagtggaacaataaggaaaagatcttttaaaaaaaagatataatacagaagccaagcaaggcggccccgacctgtaaccccagcactctgggaggcagaggcgggcgggcggatcgcttgagcccaggagtttgagaccagcctggccaacataggaaggcctcgtcaaaaagacaaaagggtaaaacgaatttaataaaatgaagtttaacttttactcatgtttgtatctaatgacaagcttttaaaactgaaaagttcactactggctcctgcctggcggctccagcccgactgggggccggggcctccctgcactgtggggtcacgagtgcccctggacagctcccgagcgccctccgacccgcatgctcagcgcagccccgtcggcggcgcgccacgggcagagcgggctcagcgggggacggaagctcagcgctgcgaccgggatcccgcaggctcgctccgcagggccgcggctcctctccgtgcaggtgctgggcccgcgggggcggggcgtccacacggtccgcgccgagacccaagcggggaaaaagcgaagagcggacagcggggcaggtgccacagggagcctccgccccaccgcgcgagcagcaagtctgcggcgcttgacacctgcactgcgaatgccaggccgcagcccgggctcccaagacgcgaatacgcgcgcctgctcgtgacgtcattttttgcggtcttcccgagagccagcagagggcgccgccatgatgttttacggaagccgatagtccttgctcagcggcaccccgtccttccggctctcggctttgccacaaagcttcccgaagacgcggccgctacccggagacgcggtcgccacccagaagcgctctcccgggaagccccgctcgtgggaccgcgccacctgcgccgcctctgcggcccgcagcccgacgggcgccgccatgttggggtcctagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccaccata

SEQ ID NO: 158209 - DNA, 2188 bp, Homo sapiens
  Payload ID: 10976
  Gene Symbol: NELFA
  Gene Name: negative elongation factor complex member A
  ENST ID: ENST00000416258
  CDS Start-End: 1-1599
aggaaggcctggggctggggtttcagccccggcgtctggacagggcagggcgctgttgttcacccccagcgccagccagcccagctgtctcacactgtgagcagcccagtgggcgcatggcagaggcacaggcacgccatggcctggctctctgcgtttcctcgtgggagggggtttatgtggccgaagcaggccctggtgtggatggatctggcctcccagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttct

SEQ ID NO: 158210 - DNA, 553 bp, Homo sapiens
  Payload ID: 10976
  Gene Symbol: NELFA
  Gene Name: negative elongation factor complex member A
  ENST ID: ENST00000443203
  CDS Start-End: 14-322
gctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagggtctggcgctgtcaaccaggctggagtgcagtggcaccatcgtgactcactgcagccttgacctcctcacctcagatcttcccatctcagcctcctgagtagctgggactacagggtttcaccatgctgcccaggctggtcttgaactcctgacctcaagcaatctgcttgcctcagcctcctgaagggctgggattacagatgaagggcgccctaatggagatcatccagctcgccagcctcgactcggacccctgggtgctcatggtcgccgacatcttgaagtcctttccggacacaggctcgcttaacctggagctggaggagca

SEQ ID NO: 158211 - DNA, 888 bp, Homo sapiens
  Payload ID: 10976
  Gene Symbol: NELFA
  Gene Name: negative elongation factor complex member A
  ENST ID: ENST00000431323
  CDS Start-End: 6-888
ataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagcatcctattttgcagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcg

SEQ ID NO: 158212 - DNA, 561 bp, Homo sapiens
  Payload ID: 10976
  Gene Symbol: NELFA
  Gene Name: negative elongation factor complex member A
  ENST ID: ENST00000411649
  CDS Start-End: 1-561
gtctctgcttccatggcctctcgtcggcagtgaagctcaagttgctactcgggacgctgcacctcccgcgccgcacggtggacgagaccccggccgtccggagcgctctgtgtccgttttactcttttctacacgccgttttgcgtcattccaataagtggatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggc

SEQ ID NO: 158213 - DNA, 2199 bp, Homo sapiens
  Payload ID: 10976
  Gene Symbol: NELFA
  Gene Name: negative elongation factor complex member A
  Uniprot ID: Q9H3P2
  ENST ID: ENST00000411638
  CDS Start-End: 17-1603
cgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaa

SEQ ID NO: 158214 - DNA, 738 bp, Homo sapiens
  Payload ID: 10976
  Gene Symbol: NELFA
  Gene Name: negative elongation factor complex member A
  ENST ID: ENST00000453740
  CDS Start-End: 1-738
cccgttcgtgtctcaggagtgtcccgcgggcaggaaggctgaggccggtgaactctcatgtgcctgcctgtgctttttctccagtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccag

SEQ ID NO: 158215 - DNA, 792 bp, Homo sapiens
  Payload ID: 10976
  Gene Symbol: NELFA
  Gene Name: negative elongation factor complex member A
  ENST ID: ENST00000458616
  CDS Start-End: 1-376
gagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagaccccggccgtccggagcgctctgtgtccgttttactcttttctacacgccgttttgcgtcattccaataagtgggtgtgtgagggtctggcgctgtcaaccaggctggagtgcagtggcaccatcgtgactcactgcagccttgacctcctcacctcagatcttcccatctcagcctcctgagtagctgggactacagggtttcaccatgctgcccaggctggtcttgaactcctgacctcaagcaatctgcttgcctcagcctcctgaagggctgggattacagagtcttgccctgtcgccaggctggagtgcagtggcgcgatctcggctcaccacaacctgcgcctcccaggttcaagggattctcctgcctcagcctcccgagtagctgggactagagacacgcgccaccatgcccagctaattagctaatttttgtatttttagtggagacggggtttcaccgtgttggccaggatggtctccatctcttgaccttgtgatccacctgccttggcctcccaaagtgctgggattacaggcatgagccactgctcccggcctttatttcttctttaaaaaaaaaaaaaaaaaaa

SEQ ID NO: 158216 - DNA, 1022 bp, Homo sapiens
  Payload ID: 10976
  Gene Symbol: NELFA
  Gene Name: negative elongation factor complex member A
  ENST ID: ENST00000455762
  CDS Start-End: 399-1022
ggacgctccaggaatcgggtgtgcctggccctggccgggggctgcccccgggagcagcgtccaggcccatggcggatgcagtctagaggactgcctggaggaggcggcgccggggcgagacctccagagcgcaaggccggcgggagaaaagctgaggaagtgggaaatctgtggctggagctcagcagattgcaacacttctacatcaagaaaatgtggcaataaggctgccaaaccctcctgtcttctgaaccgaatccttgtagattctggatatcgcaccttcataggaatattctgagaatattttctcctattcgcttccaggagccgtcgtagcagccgattaggactggctgctggtgtggtgatgacctagagggcttctcccaggtaagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctc

SEQ ID NO: 158217 - DNA, 574 bp, Homo sapiens
  Payload ID: 10976
  Gene Symbol: NELFA
  Gene Name: negative elongation factor complex member A
  ENST ID: ENST00000421397
  CDS Start-End: 1-198
atcgacaacatccgtctctgcttccatggcctctcgtcggcagtgaagctcaagttgctactcgggacgctgcacctcccgcgccgcacggtggacgagggtctggcgctgtcaaccaggctggagtgcagtggcaccatcgtgactcactgcagccttgacctcctcacctcagatcttcccatctcagcctcctgagtagctgggactacagggtttcaccatgctgcccaggctggtcttgaactcctgacctcaagcaatctgcttgcctcagcctcctgaagggctgggattacagtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccga

SEQ ID NO: 158218 - DNA, 2465 bp, Homo sapiens
  Payload ID: 10976
  Gene Symbol: NELFA
  Gene Name: negative elongation factor complex member A
  ENST ID: ENST00000542778
  CDS Start-End: 244-1863
atgatgttttacggaagccgatagtccttgctcagcggcaccccgtccttccggctctcggctttgccacaaagcttcccgaagacgcggccgctacccggagacgcggtcgccacccagaagcgctctcccgggaagccccgctcgtgggaccgcgccacctgcgccgcctctgcggcccgcagcccgacgggcgccgccatgttggggtcctagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaaggtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtccacggagaccgcccagcagttgaagcggagcgccggggtgcccttccacgccaagggccgggggctgctgcggaagatggacaccaccaccccactcaaaggcatcccgaagcaggcgcccttcagaagccccacggcgcccagcgtcttcagccccacagggaaccggacccccatcccgccttccaggacgctgctgcggaaggaacgaggtgtgaagctgctggacatctctgagctggatatggttggcgctggccgagaggcgaagcggagaaggaagactctcgatgcggaggtggtggagaagccggccaaggaggaaacggtggtggagaacgccaccccggactacgcagccggcctggtgtccacgcagaaacttgggtccctgaacaatgagcctgcgctgccctccacgagctaccttccctccacgcccagcgtggttcccgcctcctcctacatccccagctccgagacgcccccagccccatcttcccgggaagccagccgcccaccagaggagcccagcgccccgagccccacgttgccagcgcagttcaagcagcgggcgcccatgtacaacagcggcctgagccctgccacacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacgagagagcagatgttcgctgcccaggagatgttcaagacggccaacaaagtcacgcggcccgagaaggccctcatcctgggcttcatggccggctcccgagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgttagactcttactttttaaaatcttttctattttccctcgctggggcagtgccctcctacccccagggttgaggggaccaaggtggcacggtggtactgggggtgcggcagggacacccgaccacaccagagcgtgggagacggtgggccttgtcccctgcctgtgcctgcctgggagttttgtattcatcttttgtatagttgtggacatttaagacagtctttgggtacctattttcattgtaaaactatctgaaccattaaagtcgagcttttctaaagaaagccacc

SEQ ID NO: 158219 - DNA, 2698 bp, Homo sapiens
  Payload ID: 10977
  Gene Symbol: NELFB
  Gene Name: negative elongation factor complex member B
  Uniprot ID: Q8WX92
  ENST ID: ENST00000343053
  CDS Start-End: 194-2080
cgggaccgggtgggcgcatgcgcgctgggctggctgggcggggtctctcgcgccgggtgagggcgctgctcccaggaacctgcgcgcggccccggcggcgtttcccgggggccggttggcgggcggacctgggcggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccgtctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccagtttgcaggtgtggccttgtttctccttgcccagcagtgctgccttcagcggccgtgacggggccagctggacacacggtgagattttctcgtatgtaaataaaaggcattttggtaaacgtg

SEQ ID NO: 158220 - DNA, 2565 bp, Homo sapiens
  Payload ID: 10977
  Gene Symbol: NELFB
  Gene Name: negative elongation factor complex member B
  ENST ID: ENST00000634710
  CDS Start-End: 204-1946
ggtgcggggcggaagtgggcggctgcgggacgcgcgcggagtcgcgcggcgggcgggacctggccgagctggagggcgccggggagcggggctcgggcggtccccgaggcccggcggagcgggcttctggggtgtctgcggcggcgccgggggaacgggctggggatggggcgcctagccgggcggtggccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacctgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaagggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccgtctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccagtttgcaggtgtggccttgtttctccttgcccagcagtgctgccttcagcggccgtgacggggccagctggacacacggtgagattttctcgtatgtaaataaaaggcattttggtaaacgtgg

SEQ ID NO: 158221 - DNA, 2097 bp, Homo sapiens
  Payload ID: 10978
  Gene Symbol: NELFCD
  Gene Name: negative elongation factor complex member C/D
  Uniprot ID: Q8IXH7
  ENST ID: ENST00000344018
  CDS Start-End: 8-1429
ggagggcatggcgggggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgcaccagctccgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataag

SEQ ID NO: 158222 - DNA, 2137 bp, Homo sapiens
  Payload ID: 10978
  Gene Symbol: NELFCD
  Gene Name: negative elongation factor complex member C/D
  ENST ID: ENST00000460601
  CDS Start-End: 1-1781
gggagggcatggcgggggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaa

SEQ ID NO: 158223 - DNA, 2305 bp, Homo sapiens
  Payload ID: 10978
  Gene Symbol: NELFCD
  Gene Name: negative elongation factor complex member C/D
  ENST ID: ENST00000602795
  CDS Start-End: 49-1848
gaggcgcgcggccgcgcgtgcgcccgcccgcccgtccccgcctcgcgcatgcgccgcgctcgctcgcgggagggcatggcgggggccgtgccgggcgccatcatggacgaggactactacgggagcgcggccgagtggggcgacgaggctgacggcggccagcaggaggatgattctggagaaggagaggatgatgcggaggttcagcaagaatgcctgcataaattttccacccgggattatatcatggaaccctccatcttcaacactctgaagaggtattttcaggcaggagggtctccagagaatgttatccagctcttatctgaaaactacaccgctgtggcccagactgtgaacctgctggccgagtggctcattcagacaggtgttgagccagtgcaggttcaggaaactgtggaaaatcacttgaagagtttgctgatcaaacattttgacccccgcaaagcagattctatttttactgaagaaggagagaccccagcgtggctggaacagatgattgcacataccacgtggcgggaccttttttataaactggctgaagcccatccagactgtttgatgctgaacttcaccgttaagcttatttctgacgcagggtaccagggggagatcaccagtgtgtccacagcatgccagcagctagaagtgttctcgagagtgctccggacctctctagctacaattttagatggaggagaagaaaaccttgaaaaaaatctccctgagtttgccaagatggtgtgccacggggagcacacgtacctgtttgcccaggccatgatgtccgtgctggcccaggaggagcaggggggctccgctgtgcgcaggatcgcccaggaagtgcagcgctttgcccaggagaaaggtcatgacgccagtcagatcacactagccttgggcacagctgcctcctaccccagggcctgccaggctctcggggccatgctgtccaaaggagccctgaaccctgctgacatcaccgtcctgttcaagatgttcacaagcatggaccctcctccggttgaacttatccgcgttccagccttcctggacctgttcatgcagtcactctttaaaccaggggctcggatcaaccaggaccacaagcacaaatacatccacatcttggcgtacgcagcaagcgtggttgagacctggaagaagaacaagcgagtgagcatcaataaagatgagctgaagtcaacgtcaaaagctgtcgaaaccgttcacaatttgtgttgcaacgagaacaaaggggcctctgaactagtggcagaattgagcacactttatcagtgtattaggtttccagtggtagcaatgggtgtgctgaagtgggtggattggactgtatcagaaccaaggtactttcagctgcagactgaccatacccctgtccacctggcgttgctggatgagatcagcacctgccaccagctcctgcacccccaggtcctgcagctgcttgttaagctttttgagactgagcactcccagctggacgtgatggagcagcttgagttgaagaagacactgctggacaggatggttcacctgctgagtcgaggttatgtacttcctgttgtcagttacatccgaaagtgtctggagaagctggacactgacatttcactcattcgctattttgtcactgaggtgctggacgtcattgctcctccttatacctctgacttcgtgcaacttttcctccccatcctggagaatgacagcatcgcaggtaccatcaaaacggaaggcgagcatgaccctgtgacggagtttatagctcactgcaaatctaacttcatcatggtgaactaatttagagcatcctccagagctgaagcagaacattccagaacccgttgtggaaaaaccctttcaagaagctgttttaagaggctcgggcagcgtcttgaaaatgggcaccgctgggaggaggtggatgacttctttacaaaggaaaatggtagcagcttcagtgagaaactgcccttacaaacagtcccttctctgctgtcaatccaatactgctcccaaatcctgttttcagtgttcatttccctcaaggcaggcgctgggctcccacgacccctcaggacagatctggccgtcagccgcgggccgctgggaactccactcggggaactcctttccaagctgacctcagttttctcacaagaacccagttagctgatgttttattgtaattgtcttaatttgctaagaacaagtaataagtaaatttttaaaaagcctttctgctgggttggattaa

SEQ ID NO: 158224 - DNA, 1405 bp, Homo sapiens
  Payload ID: 10979
  Gene Symbol: NELFE
  Gene Name: negative elongation factor complex member E
  Uniprot ID: P18615
  ENST ID: ENST00000375425
  CDS Start-End: 170-1333
atagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctt

SEQ ID NO: 158225 - DNA, 1584 bp, Homo sapiens
  Payload ID: 10979
  Gene Symbol: NELFE
  Gene Name: negative elongation factor complex member E
  Uniprot ID: P18615
  ENST ID: ENST00000375429
  CDS Start-End: 228-1370
aagtagaggcaacttccggtacagccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacaca

SEQ ID NO: 158226 - DNA, 1566 bp, Homo sapiens
  Payload ID: 10979
  Gene Symbol: NELFE
  Gene Name: negative elongation factor complex member E
  Uniprot ID: P18615
  ENST ID: ENST00000383174
  CDS Start-End: 210-1352
gtacagccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacaca

SEQ ID NO: 158227 - DNA, 1566 bp, Homo sapiens; identical to SEQ ID NO: 158226
  Payload ID: 10979
  Gene Symbol: NELFE
  Gene Name: negative elongation factor complex member E
  Uniprot ID: P18615
  ENST ID: ENST00000383343
  CDS Start-End: 210-1352

SEQ ID NO: 158228 - DNA, 1202 bp, Homo sapiens
  Payload ID: 10979
  Gene Symbol: NELFE
  Gene Name: negative elongation factor complex member E
  Uniprot ID: P18615
  ENST ID: ENST00000444811
  CDS Start-End: 78-1130
gagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagctt

SEQ ID NO: 158229 - DNA, 765 bp, Homo sapiens
  Payload ID: 10979
  Gene Symbol: NELFE
  Gene Name: negative elongation factor complex member E
  ENST ID: ENST00000425721
  CDS Start-End: 289-765
ttttctcatagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggt

SEQ ID NO: 158230 - DNA, 1566 bp, Homo sapiens; identical to SEQ ID NO: 158226
  Payload ID: 10979
  Gene Symbol: NELFE
  Gene Name: negative elongation factor complex member E
  Uniprot ID: P18615
  ENST ID: ENST00000457397
  CDS Start-End: 210-1352

SEQ ID NO: 158231 - DNA, 1075 bp, Homo sapiens
  Payload ID: 10979
  Gene Symbol: NELFE
  Gene Name: negative elongation factor complex member E
  ENST ID: ENST00000443464
  CDS Start-End: 75-1075
cccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgc

SEQ ID NO: 158232 - DNA, 847 bp, Homo sapiens
  Payload ID: 10979
  Gene Symbol: NELFE
  Gene Name: negative elongation factor complex member E
  ENST ID: ENST00000449057
  CDS Start-End: 126-847
agccaaagacaagagtaggcagacctgaaggggtggggttgggtacagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtccttt

SEQ ID NO: 158233 - DNA, 914 bp, Homo sapiens
  Payload ID: 10979
  Gene Symbol: NELFE
  Gene Name: negative elongation factor complex member E
  ENST ID: ENST00000453084
  CDS Start-End: 34-914
gtcttgggccctgcccctgaactaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacc

SEQ ID NO: 158234 - DNA, 765 bp, Homo sapiens; identical to SEQ ID NO: 158229
  Payload ID: 10979
  Gene Symbol: NELFE
  Gene Name: negative elongation factor complex member E
  ENST ID: ENST00000426722
  CDS Start-End: 289-765

SEQ ID NO: 158235 - DNA, 1566 bp, Homo sapiens; identical to SEQ ID NO: 158226
  Payload ID: 10979
  Gene Symbol: NELFE
  Gene Name: negative elongation factor complex member E
  Uniprot ID: P18615
  ENST ID: ENST00000448628
  CDS Start-End: 210-1352

SEQ ID NO: 158236 - DNA, 847 bp, Homo sapiens; identical to SEQ ID NO: 158232
  Payload ID: 10979
  Gene Symbol: NELFE
  Gene Name: negative elongation factor complex member E
  ENST ID: ENST00000418423
  CDS Start-End: 126-847

SEQ ID NO: 158237 - DNA, 847 bp, Homo sapiens; identical to SEQ ID NO: 158232
  Payload ID: 10979
  Gene Symbol: NELFE
  Gene Name: negative elongation factor complex member E
  ENST ID: ENST00000435435
  CDS Start-End: 126-847

SEQ ID NO: 158238 - DNA, 847 bp, Homo sapiens; identical to SEQ ID NO: 158232
  Payload ID: 10979
  Gene Symbol: NELFE
  Gene Name: negative elongation factor complex member E
  ENST ID: ENST00000456281
  CDS Start-End: 126-847

SEQ ID NO: 158239 - DNA, 914 bp, Homo sapiens; identical to SEQ ID NO: 158233
  Payload ID: 10979
  Gene Symbol: NELFE
  Gene Name: negative elongation factor complex member E
  ENST ID: ENST00000437732
  CDS Start-End: 34-914

SEQ ID NO: 158240 - DNA, 1075 bp, Homo sapiens; identical to SEQ ID NO: 158231
  Payload ID: 10979
  Gene Symbol: NELFE
  Gene Name: negative elongation factor complex member E
  ENST ID: ENST00000441998
  CDS Start-End: 75-1075

SEQ ID NO: 158241 - DNA, 765 bp, Homo sapiens; identical to SEQ ID NO: 158229
  Payload ID: 10979
  Gene Symbol: NELFE
  Gene Name: negative elongation factor complex member E
  ENST ID: ENST00000418059
  CDS Start-End: 289-765

SEQ ID NO: 158242 - DNA, 1075 bp, Homo sapiens; identical to SEQ ID NO: 158231
  Payload ID: 10979
  Gene Symbol: NELFE
  Gene Name: negative elongation factor complex member E
  ENST ID: ENST00000452147
  CDS Start-End: 75-1075

SEQ ID NO: 158243 - DNA, 1566 bp, Homo sapiens; identical to SEQ ID NO: 158226
  Payload ID: 10979
  Gene Symbol: NELFE
  Gene Name: negative elongation factor complex member E
  Uniprot ID: P18615
  ENST ID: ENST00000429857
  CDS Start-End: 210-1352

SEQ ID NO: 158244 - DNA, 1075 bp, Homo sapiens; identical to SEQ ID NO: 158231
  Payload ID: 10979
  Gene Symbol: NELFE
  Gene Name: negative elongation factor complex member E
  ENST ID: ENST00000425810
  CDS Start-End: 75-1075

SEQ ID NO: 158245 - DNA, 1075 bp, Homo sapiens; identical to SEQ ID NO: 158231
  Payload ID: 10979
  Gene Symbol: NELFE
  Gene Name: negative elongation factor complex member E
  ENST ID: ENST00000440478
  CDS Start-End: 75-1075

SEQ ID NO: 158246 - DNA, 914 bp, Homo sapiens; identical to SEQ ID NO: 158233
  Payload ID: 10979
  Gene Symbol: NELFE
  Gene Name: negative elongation factor complex member E
  ENST ID: ENST00000456263
  CDS Start-End: 34-914

SEQ ID NO: 158247 - DNA, 765 bp, Homo sapiens; identical to SEQ ID NO: 158229
  Payload ID: 10979
  Gene Symbol: NELFE
  Gene Name: negative elongation factor complex member E
  ENST ID: ENST00000458622
  CDS Start-End: 289-765

SEQ ID NO: 158248 - DNA, 914 bp, Homo sapiens; identical to SEQ ID NO: 158233
  Payload ID: 10979
  Gene Symbol: NELFE
  Gene Name: negative elongation factor complex member E
  ENST ID: ENST00000434518
  CDS Start-End: 34-914

SEQ ID NO: 158249 - DNA, 914 bp, Homo sapiens; identical to SEQ ID NO: 158233
  Payload ID: 10979
  Gene Symbol: NELFE
  Gene Name: negative elongation factor complex member E
  ENST ID: ENST00000454913
  CDS Start-End: 34-914

SEQ ID NO: 158250 - DNA, 914 bp, Homo sapiens; identical to SEQ ID NO: 158233
  Payload ID: 10979
  Gene Symbol: NELFE
  Gene Name: negative elongation factor complex member E
  ENST ID: ENST00000411745
  CDS Start-End: 34-914

SEQ ID NO: 158251 - DNA, 765 bp, Homo sapiens; identical to SEQ ID NO: 158229
  Payload ID: 10979
  Gene Symbol: NELFE
  Gene Name: negative elongation factor complex member E
  ENST ID: ENST00000420039
  CDS Start-End: 289-765

SEQ ID NO: 158252 - DNA, 847 bp, Homo sapiens; identical to SEQ ID NO: 158232
  Payload ID: 10979
  Gene Symbol: NELFE
  Gene Name: negative elongation factor complex member E
  ENST ID: ENST00000424967
  CDS Start-End: 126-847

SEQ ID NO: 158253 - DNA, 765 bp, Homo sapiens; identical to SEQ ID NO: 158229
  Payload ID: 10979
  Gene Symbol: NELFE
  Gene Name: negative elongation factor complex member E
  ENST ID: ENST00000420837
  CDS Start-End: 289-765

SEQ ID NO: 158254 - DNA, 906 bp, Homo sapiens
  Payload ID: 10979
  Gene Symbol: NELFE
  Gene Name: negative elongation factor complex member E
  ENST ID: ENST00000436289
  CDS Start-End: 126-906
agccaaagacaagagtaggcagacctgaaggggtggggttgggtacagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatg

SEQ ID NO: 158255 - DNA, 1075 bp, Homo sapiens; identical to SEQ ID NO: 158231
  Payload ID: 10979
  Gene Symbol: NELFE
  Gene Name: negative elongation factor complex member E
  ENST ID: ENST00000424762
  CDS Start-End: 75-1075

SEQ ID NO: 158256 - DNA, 583 bp, Homo sapiens
  Payload ID: 10979
  Gene Symbol: NELFE
  Gene Name: negative elongation factor complex member E
  ENST ID: ENST00000492539
  CDS Start-End: 86-259
atcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaaggtgagggactgtgtgtggacatggcctaacctttcacagactctgcactctgagaagatatgggaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgactggggctatgaagaacgcagtgg

SEQ ID NO: 158257 - DNA, 568 bp, Homo sapiens
  Payload ID: 10979
  Gene Symbol: NELFE
  Gene Name: negative elongation factor complex member E
  ENST ID: ENST00000494956
  CDS Start-End: 72-182
gctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagactgtaagcttcttgagggtaggaacaatgcattagcctcctggatatccctgttacgaagtcatggctgggcctcattcaatatgcaggaaatagatggatgaagcttccaggaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtc

SEQ ID NO: 158258 - DNA, 111 bp, Homo sapiens
  Payload ID: 10979
  Gene Symbol: NELFE
  Gene Name: negative elongation factor complex member E
  ENST ID: ENST00000625545
  CDS Start-End: 1-111
atgttggtgataccccccggactgagcgaggaagaggaggctctgcagaagaaattcaacaagctcaagaaaaagactgtaagcttcttgagggtaggaacaatgcattag

SEQ ID NO: 158259 - DNA, 111 bp, Homo sapiens; identical to SEQ ID NO: 158258
  Payload ID: 10979
  Gene Symbol: NELFE
  Gene Name: negative elongation factor complex member E
  ENST ID: ENST00000628497
  CDS Start-End: 1-111

SEQ ID NO: 158260 - DNA, 111 bp, Homo sapiens; identical to SEQ ID NO: 158258
  Payload ID: 10979
  Gene Symbol: NELFE
  Gene Name: negative elongation factor complex member E
  ENST ID: ENST00000629797
  CDS Start-End: 1-111

SEQ ID NO: 158261 - DNA, 111 bp, Homo sapiens; identical to SEQ ID NO: 158258
  Payload ID: 10979
  Gene Symbol: NELFE
  Gene Name: negative elongation factor complex member E
  ENST ID: ENST00000625905
  CDS Start-End: 1-111

SEQ ID NO: 158262 - DNA, 111 bp, Homo sapiens; identical to SEQ ID NO: 158258
  Payload ID: 10979
  Gene Symbol: NELFE
  Gene Name: negative elongation factor complex member E
  ENST ID: ENST00000625436
  CDS Start-End: 1-111

SEQ ID NO: 158263 - DNA, 111 bp, Homo sapiens; identical to SEQ ID NO: 158258
  Payload ID: 10979
  Gene Symbol: NELFE
  Gene Name: negative elongation factor complex member E
  ENST ID: ENST00000625993
  CDS Start-End: 1-111

SEQ ID NO: 158264 - DNA, 2564 bp, Homo sapiens
  Payload ID: 10980
  Gene Symbol: NRROS
  Gene Name: negative regulator of reactive oxygen species
  Uniprot ID: Q86YC3
  ENST ID: ENST00000328557
  CDS Start-End: 204-2282
cctgtgctgagtcgccgagcagcccgctctccatgtgacttcagtttccgtccgttccttccgctggtgctaaaataatctgatgccccacagcaaggaggtagcccagccccgcgttcggctgctctcgaggaggccggagcccccggagacgatgcgccccgcgcagccgcctgcgcctgcgggagccggctgcccttgagatggagttgctgcctctttggctctgcctgggttttcacttcctgaccgtgggctggaggaacagaagcggaacagccacagcagcctcccaaggagtctgcaagttggtgggtggagccgctgactgccgagggcagagcctcgcttcggtgcccagcagcctcccgccccacgcccggatgctcaccctggatgccaaccctctcaagaccctgtggaatcactccctccagccttaccctctcctggagagcctcagcctgcacagctgccacctggagcgcatcagccgcggcgccttccaggagcaaggtcacctgcgcagcctggtcctgggggacaactgcctctcagagaactacgaagagacggcagccgccctccacgccctgccgggcctgcggaggctggacttgtcaggaaacgccctgacggaggacatggcagccctcatgctccagaacctctcctcgctgcggtccgtgtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgcccccatgttacaggtcctgtctctcaggaacatgggcctccactccagctttatggcgttggacttctctgggtttgggaatctcagggacttagatctgtcggggaattgcttgaccaccttcccaaggtttgggggcagcctggccctggagaccctggatctccgtagaaactcgctcacagcccttccccagaaggctgtgtctgagcagctctcgagaggtctgcggaccatctacctcagtcagaatccatatgactgctgtggggtggatggctggggggccctgcagcatgggcagacggtggccgactgggccatggtcacctgcaacctctcctccaagatcatccgcgtgacggagctgcccggaggtgtgcctcgggactgcaagtgggagcggctggacctgggcctgctctacctcgtgctcatcctccccagctgcctcaccctgctggtggcctgcactgtcatcgtcctcacttttaagaagcctctgcttcaggtcatcaagagccgctgccactggtcctccgtttactgacctggctgtgtgccaagactcgaaattcggtccgcacacaacaggacactttctctgccagctttcaagatgtgatgcagaggccaagtctgacgaattgaagtttcaattaaaatttaatatgtttccattcctcatcgcccaccccacccccgcccccaccaccgcccaagttctttttccatcattataattcatcctcattatcttggtaaaatatttattaagtgactttttcagaaataaaaggcaacgtgtctcataaatattttttaaattaaa

SEQ ID NO: 158265 - DNA, 3180 bp, Homo sapiens
  Payload ID: 10981
  Gene Symbol: NUB1
  Gene Name: negative regulator of ubiquitin-like proteins 1
  ENST ID: ENST00000413040
  CDS Start-End: 79-1956
accctctttccaagcggcggcggcggcggcggcgcgaaggcgacagcggcggcgggggcggggctggcctcacccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactacgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcgtggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgaccgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccacagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaa

SEQ ID NO: 158266 - DNA, 619 bp, Homo sapiens
  Payload ID: 10981
  Gene Symbol: NUB1
  Gene Name: negative regulator of ubiquitin-like proteins 1
  ENST ID: ENST00000470229
  CDS Start-End: 157-619
actctgctggtcgcggcgggagtggcgtggcgcaggtgaggacacggcggccgagtgtcctcgaccccagcctcagcagcactgcttggcgccccggttcccggtccgactgggcacctctcctggccaggggtggagcggccgcggggcggggggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatgg

SEQ ID NO: 158267 - DNA, 586 bp, Homo sapiens
  Payload ID: 10981
  Gene Symbol: NUB1
  Gene Name: negative regulator of ubiquitin-like proteins 1
  ENST ID: ENST00000480714
  CDS Start-End: 1-385
gagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcaggtactccacgcagccagcgggaacttggatgaggccctgaaggtagcagctccctcggggcctctggccttgtccctgagcagtgggtcctgcccagagctccctccatggctctccagcatcctcccgggctcactcctatgggctgccccgtcatccggatctgaagggcaggtttctcctgggctccagcccagacacaggctgcgtgaggccacgtgaggccccatgctcagtgcttggcccaggcctggctccaaaacgtggtgcctgtccacaccagcacagtccacaggccaggactttgtgtagggtttctgtgtgcagcagagtttagtgaaacaggcagtttccacggcagaaaaaagagaatgggaattcaacttgtagtataattgtttggcattaaaattttaaatgtaa

SEQ ID NO: 158268 - DNA, 1752 bp, Homo sapiens
  Payload ID: 10981
  Gene Symbol: NUB1
  Gene Name: negative regulator of ubiquitin-like proteins 1
  ENST ID: ENST00000470316
  CDS Start-End: 6-455
cagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaggctgtcaggggtggattcaggaagtggcatgcaacacacatgcgtagaagaccctgtggatcagcccccgctatgggcttctccagggagaccacagaagaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctggtaggcgcttttgtacttggtgaacaccagctttaaggaagatggcccagactatacagaacaccctgccatgcccttgagactgcagactttcatctacaacagtggttaatgtaaaagagtagttatggtgtaaactggtgaatttcttcttccctttgtatttctaattgacctttcctccctgtaaagaaaagaattttcaagcaggtaggatatcctctcttcttctgtacatgtgctatgttgctagtcggaactttccattataaagtttcctgtcagcttttcacctaatggttttggggtagtattgatgattattcctcaaatccgttgtttaagagctgtataatggtgatattattccttctgtacttattttttttgagacagagtctcactctgtcacccaggctggaatgcagtggcatgatctcagctcactgcaacttccatctcctgggctcaagtgatcctcccacctcagcctcctaagtagctgggatcacaggtgcacatcaccacaggtgcacatcaccatgcccagataatttttttgtatttgttgtagagatgaggtttcactatgttgcccatactagtctcaaactcctgggctcaagtgatccacccaccacagcctctcaaagtgctggtattacaggtgtgagccaccgcacccagcctcccttctgcatttattgctggaattctgaaaaatttgtttttgctcatcagttattttatatgtggaggtacaatttgtataggaaagttagaataaaatactttgtttctttctccttattttcttgttttcagaataaatgagttgcttcacta

SEQ ID NO: 158269 - DNA, 767 bp, Homo sapiens
  Payload ID: 10981
  Gene Symbol: NUB1
  Gene Name: negative regulator of ubiquitin-like proteins 1
  ENST ID: ENST00000483358
  CDS Start-End: 6-767
cagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaata

SEQ ID NO: 158270 - DNA, 664 bp, Homo sapiens
  Payload ID: 10981
  Gene Symbol: NUB1
  Gene Name: negative regulator of ubiquitin-like proteins 1
  ENST ID: ENST00000460712
  CDS Start-End: 1-608
aggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaag

SEQ ID NO: 158271 - DNA, 1703 bp, Homo sapiens
  Payload ID: 10981
  Gene Symbol: NUB1
  Gene Name: negative regulator of ubiquitin-like proteins 1
  ENST ID: ENST00000468404
  CDS Start-End: 46-849
atccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctggtaggcgcttttgtacttggtgaacaccagctttaaggaagatggcccagactatacagaacaccctgccatgcccttgagactgcagactttcatctacaacagtggttaatgtaaaagagtagttatggtgtaaactggtgaatttcttcttccctttgtatttctaattgacctttcctccctgtaaagaaaagaattttcaagcaggtaggatatcctctcttcttctgtacatgtgctatgttgctagtcggaactttccattataaagtttcctgtcagcttttcacctaatggttttggggtagtattgatgattattcctcaaatccgttgtttaagagctgtataatggtgatattattccttctgtacttattttttttgagacagagtctcactctgtcacccaggctggaatgcagtggcatgatctcagctcactgcaacttccatctcctgggctcaagtgatcctcccacctcagcctcctaagtagctgggatcacaggtgcacatcaccacaggtgcacatcaccatgcccagataatttttttgtatttgttgtagagatgaggtttcactatgttgcccatactagtctcaaactcctgggctcaagtgatccacccaccacagcctctcaaagtgctggtattacaggtgtgagccaccgcacccagcctcccttctgcatttattgctggaattctgaaaaatttgtttttgctcatcagttattttatatgtggaggtacaatttgtataggaaagttagaataaaatactttgtttctttctccttattttcttgttttcagaataaatgagttgcttcactatcaccctccaaa

SEQ ID NO: 158272 - DNA, 3210 bp, Homo sapiens
  Payload ID: 10981
  Gene Symbol: NUB1
  Gene Name: negative regulator of ubiquitin-like proteins 1
  ENST ID: ENST00000568733
  CDS Start-End: 67-1986
agcggcggcggcggcggcggcgcgaaggcgacagcggcggcgggggcggggctggcctcacccggaatgaaaacaaacggcggccgctgccgcatccgggcactctgctggtcgcggcgggagtggcgtggcgcagggatggcacaaaagaaatatcttcaagcaaaattgacccagtttttaagggaagacaggattcaactttggaaacctccatatacagatgaaaataaaaaagttggtttggcattaaaggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagataggaaaaacttgttggagacccgattgcacatcactggcagagaactgaggtccaaaatagctgaaacctttggacttcaagaaaattatatcaaaattgtcataaataagaagcaactacaactagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagagcagcagagacagtggtggatccagaaatgacaccgtacttagacatagctaaccagacaggcagatcaatcagaattcccccatcagaaagaaaagcccttatgttagctatgggatatcatgagaagggcagagctttcctgaaaagaaaagaatatggaatagccttgccatgtctgttggacgctgacaaatatttctgtgagtgttgcagagagctgctggacacagtggataactacgccgtcctccagctggatatagtgtggtgttacttccgcctggaacagctggaatgccttgatgatgcagaaaaaaaattaaacttggcccagaaatgctttaaaaattgttacggagaaaatcatcagagactggtccacataaaaggaaattgtgggaaagagaaggtactgtttctaagactctacttacttcaagggatccgaaactatcacagtggaaatgatgtagaggcttatgagtatcttaacaaggcacgtcagctctttaaagagctatatattgatccatcaaaagtggacaatttgttgcagttggggtttactgcccaggaagcccggcttggcctgagggcgtgtgatgggaacgtggatcatgcggccactcatattaccaaccgcagagaggaactggcccaaataaggaaggaggaaaaagagaagaaaagacgccgcctcgagaacatcaggtttctgaaagggatgggctactccacgcacgcggcccagcaggtactccacgcagccagcgggaacttggatgaggccctgaagattctgctcagcaatcctcagatgtggtggttaaatgattccaatcctgaaaccgacaaccgtcaagaaagtccttcccaggaaaacattgaccgattggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcgtggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgaccgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaatggcttcagcctgggacgccagtgttttatgctcttagttcagtaaaatacgcccccgaaattcaagattgagtgtcaggctttatatatattcagcattcctcattacagaaatcttctattgaatgggaaaggtttaaatgctaaccaaagcaatttatttttaattaatatttttagactctgtgctgtcatactgaactcactgctagctaagagacctatcagagatttagatatattttctccaggttttttgtgggttttctttgttgttgttgttgttctagccatgtgacagaggctctttctaaaagtatgtagttcgctgtgtgtcggctccagcagtaaccgtcctcactgcgccacgcactcctctgtagatgtgtgcccagtgggagttccttccagccccaggaccacagcagcagccaggtgccgagtggattgagtgccaggtgcatccaagactttccctcccttccagaaggcactgactgaagacaggatggatcatgcggagccggctgaaatgctccaactttttcaaagtgtgggtggtccagtttggactgatgggaatcttcttgtcattctttttaaacggatgataccgatggaaataaaaggtgggaaatatattcaaaaa

SEQ ID NO: 158273 - DNA, 4656 bp, Homo sapiens
  Payload ID: 10982
  Gene Symbol: NBR1
  Gene Name: neighbor of BRCA1 gene 1
  Uniprot ID: Q14596
  ENST ID: ENST00000341165
  CDS Start-End: 141-3041
agtaattgctgtaccaaggtcagaatcgccacctgaggcctgaatatcagcgtaagatagtgtccaaagcagtcttaagaagaggtcccattaccccactctttccgccctaatggaggtctccagtttagcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctac

SEQ ID NO: 158274 - DNA, 2703 bp, Homo sapiens
  Payload ID: 10982
  Gene Symbol: NBR1
  Gene Name: neighbor of BRCA1 gene 1
  ENST ID: ENST00000542611
  CDS Start-End: 111-2624
atccgccatgttagattcaccccacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagccaataatttctgaagatcagacagcagccctgatggcccatctctttgaaatgggattctgtgacaggcagctgaacctacggctgctgaag

SEQ ID NO: 158275 - DNA, 586 bp, Homo sapiens
  Payload ID: 10982
  Gene Symbol: NBR1
  Gene Name: neighbor of BRCA1 gene 1
  ENST ID: ENST00000586650
  CDS Start-End: 460-586
ccaaggtcagaatcgccacctgaggcctgaatatcagcgtaagatagtgtccaaagcagtcttaagaagaggtcccattaccccactctttccgccctaatggaggtctccagtttaggtaaataaaaggattgttgggaggtggagggaaagaactactatttccaacatgcattgcggaacgaaaggccttggccacactgttccttggaaactgtagtcttatggagaggaacatccaataccaaagcgggcacaattctcacggaaatccagtggatagattggagacctccgcgggcttatacatgtcaacagtaatggattggagtgttgttatgttctcctatcttgagagcagagactaggccaaaaaaagatacctacaactcctaggaagactacgattcccatccagccccacgagtctcgggcaagtagtcctctaagcctcacagcatggaaccacaggttactctaaatgtgacttttaaaaatgaaattcaaagctttctggtttctgatccagaaaatacaacttgggctgatatcgaagctatggtaaaagtttcatttgatctgaata

SEQ ID NO: 158276 - DNA, 3446 bp, Homo sapiens
  Payload ID: 10982
  Gene Symbol: NBR1
  Gene Name: neighbor of BRCA1 gene 1
  Uniprot ID: Q14596
  ENST ID: ENST00000590996
  CDS Start-End: 99-2999
agattcaccccacagggatagcggcagagccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgt

SEQ ID NO: 158277 - DNA, 3097 bp, Homo sapiens
  Payload ID: 10982
  Gene Symbol: NBR1
  Gene Name: neighbor of BRCA1 gene 1
  Uniprot ID: Q14596
  ENST ID: ENST00000589872
  CDS Start-End: 70-2883
ccggtagcggacggtccttgcattggcctccggcaggcgccccccgggggcgggaagctgcctcacagcatggaaccacaggttactctaaatgtgacttttaaaaatgaaattcaaagctttctggtttctgatccagaaaatacaacttgggctgatatcgaagctatggtaaaagtttcatttgatctgaatactattcaaataaaatacctggatgaggaaaatgaagaggtatccatcaacagtcaaggagaatatgaagaagcgcttaagatggcagttaaacagggaaaccaactgcagatgcaagtccacgaagggcaccatgtcgttgatgaagccccacccccagttgtaggagcaaaacgactagctgccagggcagggaagaagccacttgcacattactcttcactggtgagagtcttgggatcagacatgaagaccccagaggatcctgcagtgcagtcgtttccacttgttccatgtgacacagaccagcctcaagacaagcccccagactggttcacaagctacctggagacgttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggacctgctgtcctttgagctgttggatataaacattgttcaagagttggagagagtgccccacaacacccctgtggatgtgactccctgcatgtctcctctgccacatgacagtcctttaatagagaagccaggcttggggcagatagaggaagagaatgaaggggcaggatttaaagcacttcctgattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagatgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggagctctccttgtgtacatcatcatggttccccaggagtggatttaccagttaccataccagaagtttcttcagtccctgatcagatcagaggagagcccagaggctcatcaggacttgtaaacagcagacagaagagctatgaccactcaaggcaccatcatgggagcagcattgctggaggactggtgaagggggctttgtctgttgctgcctctgcatacaaggccctgtttgctgggccaccagtcactgcacagggtctctggggcttgctgtcattccttcatctggccaaaaaatgcttcttcctgaaagccccgagtgaagcattctcctggttctaagtacagttcattagctccccggtttcccttttctcctccttcaagtacacagataactaatctaaaatagggccttcccagtccgaaccgttggtatcaagtacacaggagtgccatagccttgaatctaattacctagtactttgaataaatctggaaagactagtatgcttgcaagatgatacaaatgtataaaataaacatttaaattata

SEQ ID NO: 158278 - DNA, 3759 bp, Homo sapiens
  Payload ID: 10983
  Gene Symbol: NEIL1
  Gene Name: nei-like DNA glycosylase 1
  Uniprot ID: Q96FI4
  ENST ID: ENST00000355059
  CDS Start-End: 507-1679
ctctttctcgcctcagggcctttgtactggcggttccttccgccggacacgtcgggtttcctcgtttttgcggactggcgctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcaaaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttcttggcacctcttggtctgagatggccaggtaggaagggcctgctgtccggtcctggtgacagaaggcccagctcctcacaaggcaaactgagcccccatcccagtcctcaaggctctgactctatcagaggacagtttgcctctgcaaggacagcccctcagaggtggtacaaagaccctggccccaggcagcccaggagccagagctcctccagtccagattctccagggtccagggctgccccctcatcctggcaggagccaggcaaaacccacccttcggcccctccccagccccaggcccaggccctttacctgctggcacaggggaggggcttctcaactcatggtctcttcactggcttttggtggctcgaggtccccagtctctcctgtgggggctgcaacccagaccctgcacgcacaggtaccttaggatcttgcccctacccaccaaatacctgggaagccatcccaccccagacttcccacccccaccccaagcgtgaggatgggccctaaggggactgagcagcagggttcccgatccaaggatttattccacaagaaaagactgatccctgctttaggctggggaagcagaaattaggagtccccagagccttctacaaacaaaaccccagccccagggactcagtgtggcggaggctgaagcacgagcaacagggacagcacttggaagggagaaaaggtgagcttcaggcggttgtcccgaagggtcaagtggccagcagggtctggtcgctccaagagatcgcagctggagaacaggaggggccatgaaggctctgcgagggcgagactcgacccccgccccaatcccacaccgccactcacaggatggcctcctgaaccggcagcgacaagtgcagccagcagtccacgtggctgccgtgggcctcatacagcctcaggaccagcgagcggcgctgggggctgctctccgcctgcagaggaacacgtctggtgggaggggccgagggcaggcccagttcggaaccccgtccccagcacgtcccaccccttgcctgcttgacggtctccaatacgaccgcgggtgaagacacggaaaacgcactccaggaggtggcgggcgctgggctgggggctggcagagccaacagggggaagtttaggctgtaggcagcttggataacgccagcatcctggaaagagcctggggtacgaccaggaaacaatgctggtggagaatgggggctaccctcccctgtccctagaaggggcaggaagccaggttgctggggtttgggctcagggaagggcagagaggtgtctagggctgcaggaaggccccaccgtccccagcactcacccttgtgcggcatcagtgcataggtgaactcgtggcgccccgtgtcagcagtagcgtccggggctttaggcgcccgcaagctggggtgaggagggcgcgtaggggccacgctgaagctgttggagttgtggtcgggaagacccatttctccatgccagctcccaggcctggtgggtaccccacttacagcgagaggctgaggatgctgcctcgcactgacgcgccatacttgcagtcgttgagcagggccagcccaaagccgtgttctgacagatccatccagcgatgggcccacacctggagggcagatccaagacccacttggtggccctgtgcccctctttgtgctcccagactccagagctcctgtcactaggccgagcacaagctctagaaccacacaactgaactccagctcccactgtacggggccctgggcatgccacccaacctgcctaagcctcagtttccttatctgtgaaacgggaataaataatagtactcacccc

SEQ ID NO: 158279 - DNA, 532 bp, Homo sapiens
  Payload ID: 10983
  Gene Symbol: NEIL1
  Gene Name: nei-like DNA glycosylase 1
  ENST ID: ENST00000567005
  CDS Start-End: 69-532
gaaccgcccggggacagaggcaagtggcaaagcagggagggcggaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagaaacaggttctctgagcccctctccccatc

SEQ ID NO: 158280 - DNA, 587 bp, Homo sapiens
  Payload ID: 10983
  Gene Symbol: NEIL1
  Gene Name: nei-like DNA glycosylase 1
  ENST ID: ENST00000568881
  CDS Start-End: 469-587
gctttctgatttcagagactctccgcaacagaaccatctcaagtgggtctacctcctcgcctttttttgttgttgttgttgcttggctgcgcttctgacagggcaggccgtgatgatgtttgtttatgagttaggtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggcacaccttcgcctccgattccgaaccgcccggggacagaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctt

SEQ ID NO: 158281 - DNA, 1797 bp, Homo sapiens
  Payload ID: 10983
  Gene Symbol: NEIL1
  Gene Name: nei-like DNA glycosylase 1
  Uniprot ID: Q96FI4
  ENST ID: ENST00000569035
  CDS Start-End: 412-1584
cgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggcaagtggcaaagcagggagggcggaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcaaaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaa

SEQ ID NO: 158282 - DNA, 572 bp, Homo sapiens
  Payload ID: 10983
  Gene Symbol: NEIL1
  Gene Name: nei-like DNA glycosylase 1
  ENST ID: ENST00000568059
  CDS Start-End: 308-572
gtttttgcggactggcgctttctgatttcagagactctccgcaacagaaccatctcaaggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgc

SEQ ID NO: 158283 - DNA, 780 bp, Homo sapiens
  Payload ID: 10983
  Gene Symbol: NEIL1
  Gene Name: nei-like DNA glycosylase 1
  ENST ID: ENST00000567657
  CDS Start-End: 227-780
gcagtgggaagtcaggttcttccgccacctcccagccaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagggagaatgtgctacgaaacctagcggataaggcctttgaccggcccatctgcgaggccctcctggaccagaggttcttcaatggcattggcaactatctgcgggcagagatcctgtaccg

SEQ ID NO: 158284 - DNA, 583 bp, Homo sapiens
  Payload ID: 10983
  Gene Symbol: NEIL1
  Gene Name: nei-like DNA glycosylase 1
  ENST ID: ENST00000564500
  CDS Start-End: 518-583
acacaggacttctttgagttctttcagtgaccaatctctttctcgcctcagggcctttgtactggcggttccttccgccggacacgtcgggtttcctcgtttttgcggactggcgctttctgatttcagagactctccgcaacagaaccatctcaagtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggcacaccttcgcctccgattccgaaccgcccggggacagaggcaagtggcaaagcagggagggcggaggactctgccaccctccctcaggatgcctgagggccccgagctgcacctggccagccagtttgtgaatgaggcctgcagggcgctggtg

SEQ ID NO: 158285 - DNA, 558 bp, Homo sapiens
  Payload ID: 10983
  Gene Symbol: NEIL1
  Gene Name: nei-like DNA glycosylase 1
  ENST ID: ENST00000564257
  CDS Start-End: 163-558
aaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggc

SEQ ID NO: 158286 - DNA, 771 bp, Homo sapiens
  Payload ID: 10983
  Gene Symbol: NEIL1
  Gene Name: nei-like DNA glycosylase 1
  ENST ID: ENST00000568519
  CDS Start-End: 114-572
gacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagggtctcgctctgttgcctaggctagagtacagtggcgccatcacagctcattgcagccttaacctccagggctcagaaacaggttctctgagcccctctccccatcccatggagggtggggatgggtcttacgcacccagaccgtgttcctccagggagaatgtgctacgaaacctagcggataaggcctttgaccggcccatctgcgaggccctcctggacca

SEQ ID NO: 158287 - DNA, 833 bp, Homo sapiens
  Payload ID: 10983
  Gene Symbol: NEIL1
  Gene Name: nei-like DNA glycosylase 1
  ENST ID: ENST00000565051
  CDS Start-End: 236-833
gctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgcacaccttcgcctccgattccgaaccgcccggggacagaggcaagtggcaaagcagggagggcggaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcaggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttgg

SEQ ID NO: 158288 - DNA, 559 bp, Homo sapiens
  Payload ID: 10983
  Gene Symbol: NEIL1
  Gene Name: nei-like DNA glycosylase 1
  ENST ID: ENST00000566313
  CDS Start-End: 408-559
acgtcgggtttcctcgtttttgcggactggcgctttctgatttcagagactctccgcaacagaaccatctcaagtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggcacaccttcgcctccgattccgaaccgcccggggacagaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagc

SEQ ID NO: 158289 - DNA, 2019 bp, Homo sapiens
  Payload ID: 10983
  Gene Symbol: NEIL1
  Gene Name: nei-like DNA glycosylase 1
  Uniprot ID: Q96FI4
  ENST ID: ENST00000564784
  CDS Start-End: 630-1802
cctttagtggctgcagtggcgacgagcggaacggagtgcgggttcccggggagggggcgtgcaggatcgggttgtggggggtgcgctgtagggctaaggagaagatgagctttggggggccctgaggaggaggggagtcaggattaaccgaggacagggtcgcagcgggggcatggggaggacgggcccgagagcgccgctcctccccaaaactaggatttggagcctcacgttctcccgcaaaacgagccctgtgggtgccaggccaggggcggctcccaggtgtggagggggcaaggtacgggcgtctgccgtcgctaagtgcccccttccacttaaggcacaccttcgcctccgattccgaaccgcccggggacagagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtccggctcttttcagctggtgccccgcgaggagctgccacgccatgcccacctgcgcttttacacggccccgcctggcccccggctcgccctatgtttcgtggacatccgccggttcggccgctgggaccttgggggaaagtggcagccgggccgcgggccctgtgtcttgcaggagtaccagcagttcagggagaatgtgctacgaaacctagcggataaggcctttgaccggcccatctgcgaggccctcctggaccagaggttcttcaatggcattggcaactatctgcgggcagagatcctgtaccggctgaagatccccccctttgagaaggcccgctcggtcctggaggccctgcagcagcacaggccgagcccggagctgaccctgagccagaagataaggaccaagctgcagaatccagacctgctggagctatgtcactcagtgcccaaggaagtggtccagttggggggcaaaggctacgggtcagagagcggggaggaggactttgctgcctttcgagcctggctgcgctgctatggcatgccaggcatgagctccctgcaggaccggcatggccgtaccatctggttccagggggatcctggaccgttggcacccaaagggcgcaagtcccgcaaaaagaaatccaaggccacacagctgagtcctgaggacagagtggaggacgctttgcctccaagcaaggccccttccaggacacgaagggcaaagagagaccttcctaagaggactgcaacccagcggcctgaggggaccagcctccagcaggacccagaagctcccacagtgcccaagaaggggaggaggaaggggcgacaggcagcctctggccactgcagaccccggaaggtcaaggctgacatcccatccttggaaccagaggggacctcagcctcttagcaggaggctctccttgcttgcactcaccctttcttattgtcttgccctgcatctgggggtctgaatttttgggagcaggcaatatctgaaggtgcaaacaggccctacggctgttccctgcacaactctcatggttttaattgtaccccatcttccacatctttaaagctcatgtgaaaaatgctgcatttttaataaactgatacatttgaacttc

SEQ ID NO: 158290 - DNA, 593 bp, Homo sapiens
  Payload ID: 10983
  Gene Symbol: NEIL1
  Gene Name: nei-like DNA glycosylase 1
  ENST ID: ENST00000569506
  CDS Start-End: 348-593
cgcgatcctaagaccctttcagatggtgggagagcctggagaaagagacagcgtgtgcggagggggtgctccctcagatggggggtcaggaagtctccctcaagtgtctgggacagagggacagcaggggccaaggcggagatgagatccgtgagtgaggggagccgggaagaagtaaggctgcagccgcggccccgcaaggattgggactttcgtctaaacgcggtggaagcccatggaaggaagcggttagcagcaaggcagagtcctgctccctctgcagccccagctcccagcgccctgggctttccaggcacctgtccgggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctggggcccagccccaacaggagccactggccctggtcttccgcttcggcatgtcc

SEQ ID NO: 158291 - DNA, 584 bp, Homo sapiens
  Payload ID: 10983
  Gene Symbol: NEIL1
  Gene Name: nei-like DNA glycosylase 1
  ENST ID: ENST00000566752
  CDS Start-End: 392-584
gtactggcggttccttccgccggacacgtcgggtttcctcgtttttgcggactggcgctttctgatttcagagactctccgcaacagaaccatctcaagtctgactgttcgttggtgcttaagatccccaccgggtccctagggcctgtgcgtaccgcgcacctgtgcacgtcctgcgcgcagctgcaggcgactccgctctggctcgtcgctgctgtttcctgctgggggtgccgaccctgtcccacgctagctgggtgacttcccccaaccgcagagacagcggcgacccggggcctcagacctgcccccgcatctcgccggcgccaggcagtgggaagtcaggttcttccgccacctcccagccaggactctgccaccctccctcaggatgcctgagggccccgagctgcacctggccagccagtttgtgaatgaggcctgcagggcgctggtgttcggcggctgcgtggagaagtcctctgtcagccgcaaccctgaggtgccctttgagagcagtgcctaccgcatctcagcttcagcccgcggcaaggagctgcgcctgatactgagccctctgcctg

SEQ ID NO: 158292 - DNA, 2671 bp, Homo sapiens
  Payload ID: 10984
  Gene Symbol: NEIL2
  Gene Name: nei-like DNA glycosylase 2
  Uniprot ID: Q969S2
  ENST ID: ENST00000284503
  CDS Start-End: 600-1598
gcgggctgcgtagcggtgctgggtcgggccgacgtgccacccacccggagccggtgagtgcagccgcccgccctccggtagatctgcggcctggcggagaagtcgggaggggacaggaagggagggcgggccccgggccctcctccgtctcagccgcctgcggaggtgctgcccacgcctggaggcccccactgaccctcagacccgcgtctgcgcccctctccccgcaccccgaggcagagttgggaaagcagtggtcttagaccccccacctcgggcactcggaagagaacggcggagacaacccctcctcttccctggctggcgcagcgccagcctcgagctcctcggtagcccccgggcagggagggccggagggtgggcgcggcatcttcagcgactcttcgaagtcccttccgcgtctcatctttcaaggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgttactcgct

SEQ ID NO: 158293 - DNA, 2016 bp, Homo sapiens
  Payload ID: 10984
  Gene Symbol: NEIL2
  Gene Name: nei-like DNA glycosylase 2
  Uniprot ID: Q969S2
  ENST ID: ENST00000403422
  CDS Start-End: 129-944
gaaatctccgcccccagctggagcggctgtgcgggctgcgtagcggtgctgggtcgggccgacgtgccacccacccggagccggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgttactcgc

SEQ ID NO: 158294 - DNA, 2226 bp, Homo sapiens
  Payload ID: 10984
  Gene Symbol: NEIL2
  Gene Name: nei-like DNA glycosylase 2
  Uniprot ID: Q969S2
  ENST ID: ENST00000436750
  CDS Start-End: 156-1154
ggagccccgcagcctccacctacaggggcgtcccctaaggggacggaggccgcatgggccgccgagccgggaaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgttactcgc

SEQ ID NO: 158295 - DNA, 2323 bp, Homo sapiens
  Payload ID: 10984
  Gene Symbol: NEIL2
  Gene Name: nei-like DNA glycosylase 2
  Uniprot ID: Q969S2
  ENST ID: ENST00000455213
  CDS Start-End: 258-1256
gccgagccgggaaatctccgcccccagctggagcggctgtgcgggctgcgtagcggtgctgggtcgggccgacgtgccacccacccggagccggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagtgtgggtcagaggtgccagtagtataatattcgtctccctggagttatgttgaaggcagagttttcatagggttagattttttttatccttttctagttcagttaattcatcctgttgaattgcaccatcgtgaaagatgggaaaaatcgtgatgatgggtaaggggaaaacttcccggaaggcaatggggcaaggaaaaagaaagcctatgggaaatggctgtgctcccaacatagctttgcagatgatgtgggttttttttttttttttggttgtttgttttgagagagagtcttgctctgtctccctggctagggtgtggtggtgtgatcttggctcacggcagccttgccctccctggctcaagcagtcttcatctcagcctccagagtagctgggactacaggcatgtgatatgatgctcggctgatttttgtttactttttagagagatggggtcttgccatatttgccaggctggtttgaactcctacaactcaagcattcctcccaccttggtctcccaaaatgttgggaccacgggtgtgagccaccgcgcccagctagctcctgtgttttgtttttgttttgtaactttggttgatgttaaggccctccattttggaaagcaggaaaacaggatttttttttttttatcttgttccctggaggatccagggatgaggatagagtggcctgagagcagtgcttggattcagcctcctgctgggtccttctgctggatacaggcaccaagaggcggtcgtggagcagggagctgcgccttcctggggtgcccggtggtgtgtagagaaaagctgcttgtttactccttaagtcaatgtattggtgactgttgatttgttgaacaattcaggaatcaagggctgtggagaaactccctcatgttgttggcaacaggtgaatgaacctagagcggtgacatgaaaataaagctcactgtta

SEQ ID NO: 158296 - DNA, 998 bp, Homo sapiens
  Payload ID: 10984
  Gene Symbol: NEIL2
  Gene Name: nei-like DNA glycosylase 2
  Uniprot ID: Q969S2
  ENST ID: ENST00000528323
  CDS Start-End: 247-897
aaatctccgcccccagctggagcggctgtgcgggctgcgtagcggtgctgggtcgggccgacgtgccacccacccggagccggctgttgcagaggcggcttgcttcccacctgtccatctccataaaaatccctaaacgaaacatgcccacgtgtccggagattttcaggacttggtgcatttcagatgaaggcttttccagaagcttccccgtagaagaggatcaggcatccaactggttaagggatgccagaagggccgttggtgaggaaatttcaccatttggtctccccctttgtgggtcagcaggtggtcaagacagggggcagcagtaagaagctacagcccgccagcctgcagtctctgtggctccaggacacccaggtgaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggcaagttccaaggcagaccgcagcacacacaggtctaccagaaagaacagtgccctgctggccaccaggtcatgaaggaggcgtttgggcccgaagatgggttacagaggctcacctggtggtgcccgcagtgccagccccagttgtcagaggagccagagcagtgccagttctcctaaggagctggtggtgctcctcacggaaccttgccgcttggggaacctgacgtctaagtgtccagaaaggaggatgtgggcagggacggggtacagaggatagt

SEQ ID NO: 158297 - DNA, 554 bp, Homo sapiens
  Payload ID: 10984
  Gene Symbol: NEIL2
  Gene Name: nei-like DNA glycosylase 2
  ENST ID: ENST00000528113
  CDS Start-End: 85-267
aaatctccgcccccagctggagcggctgtgcgggctgcgtagcggtgctgggtcgggccgacgtgccacccacccggagccgggatgccagaagggccgttggtgaggaaatttcaccatttggtctccccctttgtgggtcagcaggtggtcaagacagggggcagcagtaagaagctacagcccgccagcctgcagtctctgtggctccaggacacccaggttggtcctgcactttggtggtggtggcttcctggcattttataattgtcagttgtcttggagctcttccccagtggtcacacccacctgtgacatcctgtctgagaagttccatcgaggacaagccttagaagctctaggccaggctcagcctgtctgctatacactgctggaccagagatacttctcagggctagggaacatcattaagaatgaagccttgtacagagctgggatccatcccctttctctcggttcagtcctgagtgcctcgcgtcgggaggtcctggtggatcacgtggtggagttcagtacagcctggctgcagggca

SEQ ID NO: 158298 - DNA, 2408 bp, Homo sapiens
  Payload ID: 10985
  Gene Symbol: NEIL3
  Gene Name: nei-like DNA glycosylase 3
  Uniprot ID: Q8TAT5
  ENST ID: ENST00000264596
  CDS Start-End: 119-1936
agacgcgcgcgagatttgaatttcctctgcgtgcggtcagtgcccgcgcagcgttgagttgcacagcggtattctcaccaggccctgcaatcggtgggccacagtgccggccacagagatggtggaaggaccaggctgtactctgaatggagagaagattcgcgcgcgggtgctcccgggccaggcggtgaccggcgtgcggggaagcgctctgcggagtctgcagggccgcgccttgcggctcgcagcctccacggttgtggtctccccgcaggctgctgcactgaataatgattccagccagaatgtcttgagcctgtttaatggatatgtttacagtggcgtggaaactttggggaaggagctctttatgtactttggaccaaaagctttacggattcatttcggaatgaaaggcttcatcatgattaatccacttgagtataaatataaaaatggagcttctcctgttttggaagtgcagctcaccaaagatttgatttgtttctttgactcatcagtagaactcagaaactcaatggaaagccaacagagaataagaatgatgaaagaattagatgtatgttcacctgaatttagtttcttgagagcagaaagtgaagttaaaaaacagaaaggccggatgctaggtgatgtgctaatggatcagaacgtattgcctggagtagggaacatcatcaaaaatgaagctctctttgacagtggtctccacccagctgttaaagtttgtcaattaacagatgaacagatccatcacctcatgaaaatgatacgtgatttcagcattctcttttacaggtgccgtaaagcaggacttgctctctctaaacactataaggtttacaagcgtcctaattgtggtcagtgccactgcagaataactgtgtgccgctttggggacaataacagaatgacatatttctgtcctcactgtcaaaaagaaaatcctcaacatgttgacatatgcaagctaccgactagaaatactataatcagttggacatctagcagggtggatcatgttatggactccgtggctcggaagtcggaagagcactggacctgtgtggtgtgtactttaatcaataagccctcttctaaggcatgtgatgcttgcttgacctcaaggcctattgattcagtgctcaagagtgaagaaaattctactgtctttagccacttaatgaagtacccgtgtaatacttttggaaaacctcatacagaagtcaagatcaacagaaaaactgcatttggaactacaactcttgtcttgactgattttagcaataaatccagtactttggaaagaaaaacaaagcaaaaccagatactagatgaggagtttcaaaactctcctcctgctagtgtttgtttgaatgatatacagcacccctccaagaagacaacaaacgatataactcaaccatccagcaaagtaaacatatcacctacaatcagttcagaatctaaattatttagtccagcacataaaaaaccgaaaacagcccaatactcatcaccagagcttaaaagctgcaaccctggatattctaacagtgaacttcaaattaatatgacagatggccctcgtaccttaaatcctgacagccctcgctgcagtaaacacaaccgcctctgcattctccgagttgtggggaaggatggggaaaacaagggcaggcagttttatgcctgtcctctacctagagaagcacaatgtggattttttgaatgggcagatttgtccttcccattctgcaaccatggcaagcgttccaccatgaaaacagtattgaagattggacctaacaatggaaagaatttttttgtgtgtcctcttgggaaggaaaaacaatgcaattttttccagtgggcagaaaatgggccaggaataaaaattattcctggatgctaatatctgtagattctctggcatttagtctcttcaaactgtgtataatgtttggtcctcctctgtttcatagaaaagtcatagaatatctatgatacattgaaaagttactgcaatatttgagaactgttctttttttttcttgtgtgtgccatctttccattgttggctacgtcttttcttttgccttgatgaacgttctatgtatttcatcggatatacagcatattccatttaggatgtgtatttaatgcatttagtaatgacgataaagtgtttttagtatgcttttagtctcttgtaactggggagaagcagtgttttttttttaggaaaggattatgcgacacaataaaataagatattctgtctgtagtgaatacatttctcatgtactaacactatttataatatatgattaaagatatttcttgttttattaaataataagaaataagatctcctttatgaacaa

SEQ ID NO: 158299 - DNA, 1528 bp, Homo sapiens
  Payload ID: 10985
  Gene Symbol: NEIL3
  Gene Name: nei-like DNA glycosylase 3
  ENST ID: ENST00000513321
  CDS Start-End: 52-243
ggtattctcaccaggccctgcaatcggtgggccacagtgccggccacagagatggtggaaggaccaggctgtactctgaatggagagaagattcgcgcgcgggtgctcccgggccaggcggtgaccggcgtgcggggaagcgctctgcggagtctgcagggccgcgccttgcggctcgcagcctccacggttgtggtctccccgcaggattcatttcggaatgaaaggcttcatcatgattaatccacttgagtataaatataaaaatggagcttctcctgttttggaagtgcagctcaccaaagatttgatttgtttctttgactcatcagtagaactcagaaactcaatggaaagccaacagagaataagaatgatgaaagaattagatgtatgttcacctgaatttagtttcttgagagcagaaagtgaagttaaaaaacagaaaggccggatgctaggtgatgtgctaatggatcagaacgtattgcctggagtagggaacatcatcaaaaatgaagctctctttgacagtggtctccacccagctgttaaaattcagtgctcaagagtgaagaaaattctactgtctttagccacttaatgaagtacccgtgtaatacttttggaaaacctcatacagaagtcaagatcaacagaaaaactgcatttggaactacaactcttgtcttgactgattttagcaataaatccagtactttggaaagaaaaacaaagcaaaaccagatactagatgaggagtttcaaaactctcctcctgctagtgtttgtttgaatgatatacagcacccctccaagaagacaacaaacgatataactcaaccatccagcaaagtaaacatatcacctacaatcagttcagaatctaaattatttagtccagcacataaaaaaccgaaaacagcccaatactcatcaccagagcttaaaagctgcaaccctggatattctaacaggtatgatgcttttaaccttggtctttaagataattgcttttttttttttttttttaagacgaggtctcactctgtcacctaggctacagtgcagtggtgtgatctcagctcactgcaacctctgcctcccgcgttcaagcgattctcctgcctcagcctcccaagtagctgagattacaggcacatgccatcaggcccgactaatttttgtattttcagtagagacggggtttcaccatgttggccaggctggtctcaatctcctgatctcaagttatctgcccacctccgcctctcaaggtgctgggatttacaggcttgagccaccatgcccggctggttgcattaagttttaagaagacagaaattgtcccttggtaaggaagttgaattacttttggtaacatgaatcaaaccctaaaagactattatagtagtctgtctcccttcccttctctagattataatgttagagaagggaaggaaatgaaaaacgtaatttcctacatgtatgaaaagttgggttttttttttttctgacaataaccata

SEQ ID NO: 158300 - DNA, 4047 bp, Homo sapiens
  Payload ID: 10986
  Gene Symbol: NLK
  Gene Name: nemo-like kinase
  Uniprot ID: Q9UBE8
  ENST ID: ENST00000407008
  CDS Start-End: 719-2302
ccccggctctctttctcctctctgtcctgctgtcgcctcctctcctcactccagcctccttccctggcttattctgcccaggaaagtttggaacccccgccccccctccccaatcaggtcaacctgactaggagtagggggagatgtaggaaggcctgagagttcggggggggggaagctggaagctggtttcccagaaaatttccccccatcttctccatttagggtggtgggaattttttttaatcctgtttttgaggaggtggtaggtgtttagaaaaggatgtgggaatggaaggggtagatgagtcaaccctctttcaagattccaagggtggtgtgttacctgatccttttcgtgtgtggagttcagggggtcgggaggtttggcctttattcccacattcaaagttggaacctcccccaaattaagaatggagttttagtacccacttgtggcaggaatcctggggggaaggggtccttttttcctttttcttttcttttttcccttttttttccttttggcaacccacacccttccacacacgctcaccccaaaattaaacaccaagatcctctaacttgtttggattgactgatgaagacataaagctctatgttttttgaggtggagtgagtggtttttcttcatttttaaatggccaaatgacagcttgacccagtttgctttccaatcaaagggcatttattttgaatgtctctttgtggcgcaagagccaacgcaaaaatgatggcggcttacaatggcggtacatctgcagcagcagcaggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcagccgcagcagcggctgcagctgcagccatgttaaaccctgggcaacaacagccatatttcccatcaccggcaccggggcaggctcctggaccagctgcagcagccccagctcaggtacaggctgccgcagctgctacagttaaggcgcaccatcatcagcactcgcatcatccacagcagcagctggatattgagccggatagacctattggatatggagcctttggtgttgtctggtcagtaacagatccaagagatggaaagagagtagcgctcaaaaagatgcccaacgtcttccagaatctggtctcttgcaaaagggtcttccgggaattgaagatgttgtgtttttttaagcatgataatgtactctctgcccttgacatactccaacctccacacattgactattttgaagaaatatatgttgtcacagaattgatgcagagtgacctacataaaattatcgtctctcctcaaccactcagctcagatcatgtcaaagtttttctttatcagattttgcgaggtttgaaatatctccattcagctggcattttacatcgagacattaagccagggaatctccttgtgaacagcaactgtgttctaaagatttgtgattttggattggccagagtggaagaattagatgaatcccgtcatatgactcaggaagttgttactcagtattatcgggctccagaaatcctgatgggcagccgtcattacagcaatgctattgacatctggtctgtgggatgtatctttgcagaactactaggacgaagaatattgtttcaggcacagagtcccattcagcagttggatttgatcacggatctgttgggcacaccatcactggaagcaatgaggacagcttgtgaaggcgctaaggcacatatactcaggggtcctcataaacagccatctcttcctgtactctataccctgtctagccaggctacacatgaagctgttcatctcctttgcaggatgttggtctttgatccatccaaaagaatatccgctaaggatgccttagcccacccctacctagatgaagggcgactacgatatcacacatgtatgtgtaaatgttgcttttccacctccactggaagagtttataccagtgactttgagcctgtcaccaatcccaaatttgatgacactttcgagaagaacctcagttctgtccgacaggttaaagaaattattcatcagttcattttggaacagcagaaaggaaacagagtgcctctctgcatcaaccctcagtctgctgcttttaagagctttattagttccactgttgctcagccatctgagatgcccccatctcctctggtgtgggagtgatggtggaagataatgtactactgaagatgtaatgtagctttccactggagtctgggatttgcaattctggaggttaatcatgcttgtactgtaattttactaatgaagttttaaattaacaaccactacttgtatgatatgaataatatttagaaatgttactagacttttaatcttgtaaagtggttgtgcttttagaagaaaaatattttacccagagttgcacatgttttatgaatttagtgcagctgttatggctcacctcagaacaaaagagaattgaaccaaatttgggagtttggggttttatgttttgtttttcttttctaaaatgaagtgagattgttcacacacacacacacacacacacacacacacaaacacaaaggacagtcatacattttgatatttgagccattcctaaagatttggggttttctaaaactaaagaatctaggaaccttgcctgcgaccaatcatggagccacgtgagctgatcgtggctgcacctggggggagggtagggaggaggggcatgccacctaatgatcaagccctataattagcttctcattagagccgtgatggtgatgtgtgctgtctaaaatccaatgttgtgggtagagagaatgagtttgtgactaggagagactaaacttttgttttccttacccagtataaatatatatatatatatttaatctatttttattagaagtttttctgctctttcttacataaaagaaccccaagcatgcatctttcatgtgtgtaaataattcatttctgggctaatttcaaaagaatcccaatattgctgtatagaaagagaactagcttgcacattttaggtctgtgaaattttgtgagacttttcctgcactggacagtaaaaaaataataaaagacaaaaacaaatttaaaaaaaaatttaagccacaaaaaaaggcacatagggaattatgtcaaatgtgtttgtgtccttaggcaaagctgtgggagtcttgaaatgtcacagtagtaaataacttattactttttgacaagttctttttttctgttggaacactgaattcttctgtgcatatgtacatatgaatacaaatcgaaggcctctacctcctggagttatacaacttggcttgtttacctccacatgctgatgatgactattttttttttttgagttcagtgtggagacttgaaacttgaatgtcccttccaacttttatattaaaaataaaaagacaagaaaattgaagatcatttttcacctgtacaaggaatactaatggatcgtcttaaaattggtctaggaaaaaaccttggtgtgtgttatggacaattaactgttaaagttattgtaagttatctgtatttagcagagtattttcaacttgagtgatctgagctgaatttgaagactattaataagttatgtttggaagttttaacttcaatgaagtaattatttgctgtgaaagaaacaaacattgaattactaaacaaagatggtgcaatatctttgttttttttttatgaggctcctgagaatcaacccaactgaagcatttcaattcacttgaatgagaaacgtgtttagtatcaaaagagcccaagaagacactggtgtgaaaggtacaatctcagaggttggtcaattaccgtggcacactttctggtcactttgtacaatgtagatttgaagtacagtggtgaaaacattaaatgtgacatttgaaaaa

SEQ ID NO: 158301 - DNA, 1702 bp, Homo sapiens
  Payload ID: 10986
  Gene Symbol: NLK
  Gene Name: nemo-like kinase
  ENST ID: ENST00000496808
  CDS Start-End: 1-1428
cttcatccggggtcggctgccgctgtacaccctgtacagcagcacacctcttcggcagctgcggcagccgcagcagcggctgcagctgcagccatgttaaaccctgggcaacaacagccatatttcccatcaccggcaccggggcaggctcctggaccagctgcagcagccccagctcaggtacaggctgccgcagctgctacagttaaggcgcaccatcatcagcactcgcatcatccacagcagcagctggatattgagccggatagacctattggatatggagcctttggtgttgtctggtcagtaacagatccaagagatggaaagagagtagcgctcaaaaagatgcccaacgtcttccagaatctggtctcttgcaaaagggtcttccgggaattgaagatgttgtgtttttttaagcatgataatgtactctctgcccttgacatactccaacctccacacattgactattttgaagaaatatatgttgtcacagaattgatgcagagtgacctacataaaattatcgtctctcctcaaccactcagctcagatcatgtcaaagtttttctttatcagattttgcgaggtttgaaatatctccattcagctggcattttacatcgagacattaagccagggaatctccttgtgaacagcaactgtgttctaaagatttgtgattttggattggccagagtggaagaattagatgaatcccgtcatatgactcaggaagttgttactcagtattatcgggctccagaaatcctgatgggcagccgtcattacagcaatgctattgacatctggtctgtgggatgtatctttgcagaactactaggacgaagaatattgtttcaggcacagagtcccattcagcagttggatttgatcacggatctgttgggcacaccatcactggaagcaatgaggacagcttgtgaaggcgctaaggcacatatactcaggggtcctcataaacagccatctcttcctgtactctataccctgtctagccaggctacacatgaagctgttcatctcctttgcaggatgttggtctttgatccatccaaaagaatatccgctaaggatgccttagcccacccctacctagatgaagggcgactacgatatcacacatgtatgtgtaaatgttgcttttccacctccactggaagagtttataccagtgactttgagcctgtcaccaatcccaaatttgatgacactttcgagaagaacctcagttctgtccgacaggttaaagaaattattcatcagttcattttggaacagcagaaaggaaacagagtgcctctctgcatcaaccctcagtctgctgcttttaagagctttattagttccactgttgctcagccatctgagatgcccccatctcctctggtgtgggagtgatggtggaagataatgtactactgaagatgtaatgtagctttccactggagtctgggatttgcaattctggaggctcctgagaatcaacccaactgaagcatttcaattcacttgaatgagaaacgtgtttagtatcaaaagagcccaagaagacactggtgtgaaaggtacaatctcagaggttggtcaattaccgtggcacactttctggtcactttgtacaatgtagatttgaagtacagtggtgaaaacattaaatgtgacatttgaaaaa

SEQ ID NO: 158302 - DNA, 1503 bp, Homo sapiens
  Payload ID: 10986
  Gene Symbol: NLK
  Gene Name: nemo-like kinase
  ENST ID: ENST00000582037
  CDS Start-End: 36-581
cagtttgctttccaatcaaagggcatttattttgaatgtctctttgtggcgcaagagccaacgcaaaaatgatggcggcttacaatggcggtacatctgcagcagcagcaggtcaccaccaccaccatcaccaccaccttccacacctccctcctcctcacctgcaccaccaccaccaccctcaacaccatcttcatccggggtcggctgccgctgtacaccctgtacagcagcacacctcttcggcagctgcggcagccgcagcagcggctgcagctgcagccatgttaaaccctgggcaacaacagccatatttcccatcaccggcaccggggcaggctcctggaccagctgcagcagccccagctcaggtacaggctgccgcagctgctacagttaaggcgcaccatcatcagcactcgcatcatccacagcagcagctggatattgagccggatagacctattggatatggagcctttggtgttgtctggttgagaatctgtagtactgagaagtttctccactatcagccgagattaacagccacagctggattctttgggggctctgctttgtgaaaagagctttgaagaagcagagcctgcaccataaaaaggaaacggttgctcttctagacataacaaagcatccgtatgaaactagaaatgtggaaatctgtattgttaattttaactacaaacgaacttacttttggaaattacaggttcatgatcataaagtagataaagagtagagaataaaagtaacaatctgatgattctgcacccacttcttggtggttgaaactccatagcctataacgttgcaagtcattttgtacttagactcctgaaaagattatccaaattatgttcaaaaaaccacagcacaaaaaataaacttgttttattcttggggagaaatttcatgttatactgtccaatattaatttagaaaaaaagacagtttttttttttaaggcatttcagaaacattgccctttcaagcaagttagaacaatatccctcaacattaaataccatctttttagccatcagtaccactgggcatgtgtcataaaagagaaatgggggcagatatagctccctttcatatgctataccagaacaaaaatttgtaaaatgcataagtgcattaactgaatatgtttgaatttaaattctgggtttttaccttcaaagcacaggcagctgtagatacaaaaagtcctctaatggagtactggaatgtttcattgtcttcacaacttggagtgtcagagttttctctgccttctatattgtaaaactgagtgactattcttggtcgtttttattagatttattgatgtccaagcaatacaagaattaactgttcatatactgtatgtttccttaacatgcttatttggtttctttgatggagattgtcaaggccaaagaaactttttcatttgtcatccaaccaataaatggacagaagctgttagaagctctttaa

SEQ ID NO: 158303 - DNA, 7088 bp, Homo sapiens
  Payload ID: 10987
  Gene Symbol: NEO1
  Gene Name: neogenin 1
  Uniprot ID: Q92859
  ENST ID: ENST00000261908
  CDS Start-End: 193-4578
gagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaac

SEQ ID NO: 158304 - DNA, 7342 bp, Homo sapiens
  Payload ID: 10987
  Gene Symbol: NEO1
  Gene Name: neogenin 1
  Uniprot ID: Q92859
  ENST ID: ENST00000339362
  CDS Start-End: 448-4833
ggtcagcggctgcgcggccggccccctcccacgggagccgcgccagggcccagcaagagtcgggcgggatcgctattgtttttggcgagcacataaatccccgggccgacccactgcgcacccaggtttcctcccggaggcctttcggtttcctctgaggccctatatagaggctccaggcccggactgtgcagaggtgcgcgcccacgccggcctcccggaccagcctgagctcggagcgcctctcgccctcaggagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaa

SEQ ID NO: 158305 - DNA, 4441 bp, Homo sapiens
  Payload ID: 10987
  Gene Symbol: NEO1
  Gene Name: neogenin 1
  Uniprot ID: Q92859
  ENST ID: ENST00000558964
  CDS Start-End: 67-4419
gggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgact

SEQ ID NO: 158306 - DNA, 4315 bp, Homo sapiens
  Payload ID: 10987
  Gene Symbol: NEO1
  Gene Name: neogenin 1
  Uniprot ID: Q92859
  ENST ID: ENST00000560262
  CDS Start-End: 67-4293
gggagggaaggaggcaagggctccgcggcgctgtcgccgccgctgccgctcactctcggggaagagatggcggcggagcggggagcccggcgactcctcagcaccccctccttctggctctactgcctgctgctgctcgggcgccgggcgccgggcgccgcggccgccaggagcggctccgcgccgcagtccccaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtcttccaagatttaccagccaaccagaaccttcctcagtttatgctgggaacaatgcaattctgaattgtgaagttaatgcagatttggtcccatttgtgaggtgggaacagaacagacaaccccttcttctggatgatagagttatcaaacttccaagtggaatgctggttatcagcaatgcaactgaaggagatggcgggctttatcgctgcgtagtggaaagtggtgggccaccaaagtatagtgatgaagttgaattgaaggttcttccagatcctgaggtgatatcagacttggtatttttgaaacagccttctcccttagtcagagtcattggtcaggatgtagtgttgccatgtgttgcttcaggacttcctactccaaccattaaatggatgaaaaatgaggaggcacttgacacagaaagctctgaaagattggtattgctggcaggtggtagcctggagatcagtgatgttactgaggatgatgctgggacttatttttgtatagctgataatggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagacacttctgaagttgatttatttgttattaatgctccatacactccagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcggactcctctgataaaatgcctaatgatcaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgact

SEQ ID NO: 158307 - DNA, 5895 bp, Homo sapiens
  Payload ID: 10987
  Gene Symbol: NEO1
  Gene Name: neogenin 1
  ENST ID: ENST00000560328
  CDS Start-End: 1-3393
ggaaatgagacaattgaagctcaagcagagcttacagtgcaagctcaacctgaattcctgaagcagcctactaatatatatgctcacgaatctatggatattgtatttgaatgtgaagtgactggaaaaccaactccaactgtgaagtgggtcaaaaatggggatatggttatcccaagtgattattttaagattgtaaaggaacataatcttcaagttttgggtctggtgaaatcagatgaagggttctatcagtgcattgctgaaaatgatgttggaaatgcacaagctggagcccaactgataatccttgaacatgatgttgccatcccaacattacctcccacttcactgaccagtgccactactgaccatctagcaccagccacaacgggaccactgccttcagctcctcgggatgtcgtggcctccctggtctctacccgcttcatcaaattgacgtggcggacacctgcatcagatcctcacggagacaaccttacctactctgtgttctacaccaaggaagggattgctagggaacgtgttgagaataccagtcacccaggagagatgcaagtaaccattcaaaacctaatgccagcgaccgtgtacatctttagagttatggctcaaaataagcatggctcaggagagagttcagctccactgcgagtagaaacacaacctgaggttcagctccctggcccagcacctaaccttcgtgcatatgcagcttcgcctacctccatcactgttacgtgggaaacaccagtgtctggcaatggggaaattcagaattataaattgtactacatggaaaaggggactgataaagaacaggatgttgatgtttcaagtcactcttacaccattaatgggttgaaaaaatatacagagtatagtttccgagtggtggcctacaataaacatggtcctggagtttccacaccagatgttgctgttcgaacattgtcagatgttcccagtgctgctcctcagaatctgtccttggaagtgagaaattcaaagagtattatgattcactggcagccacctgctccagccacacaaaatgggcagattactggctacaagattcgctaccgaaaggcctcccgaaagagtgatgtcactgagaccttggtaagcgggacacagctgtctcagctgattgaaggtcttgatcgggggactgagtataatttccgagtggctgctctaacaatcaatggtacaggcccggcaactgactggctgtctgctgaaacttttgaaagtgacctagatgaaactcgtgttcctgaagtgcctagctctcttcacgtacgcccgctcgttactagcatcgtagtgagctggactcctccagagaatcagaacattgtggtcagaggttacgccattggttatggcattggcagccctcatgcccagaccatcaaagtggactataaacagcgctattacaccattgaaaatctggatcccagctctcactatgtgattaccctgaaagcatttaataacgtgggtgaaggcatccccctgtatgagagtgctgtgaccaggcctcacacagtgccagatcccactcccatgatgccaccagtgggagttcaggcttccattctgagtcatgacaccatcaggattacgtgggcagacaactcgctgcccaagcaccagaagattacagactcccgatactacaccgtccgatggaaaaccaacatcccagcaaacaccaagtacaagaatgcaaatgcaaccactttgagttatttggtgactggtttaaagccgaatacactctatgaattctctgtgatggtgaccaaaggtcgaagatcaagtacatggagtatgacagcccatgggaccacctttgaattagttccgacttctccacccaaggatgtgactgttgtgagtaaagaggggaaacctaagaccataattgtgaattggcagcctccctccgaagccaatggcaaaattacaggttacatcatatattacagtacagatgtgaatgcagagatacatgactgggttattgagcctgttgtgggaaacagactgactcaccagatacaagagttaactcttgacacaccatactacttcaaaatccaggcacggaactcaaagggcatgggacccatgtctgaagctgtccaattcagaacacctaaagcctcagggtctggagggaaaggaagccggctgccagacctaggatccgactacaaacctccaatgagcggcagtaacagccctcatgggagccccacctctcctctggacagtaatatgctgctggtcataattgtttctgttggcgtcatcaccatcgtggtggttgtgattatcgctgtcttttgtacccgtcgtaccacctctcaccagaaaaagaaacgagctgcctgcaaatcagtgaatggctctcataagtacaaagggaattccaaagatgtgaaacctccagatctctggatccatcatgagagactggagctgaaacccattgataagtctccagacccaaaccccatcatgactgatactccaattcctcgcaactctcaagatatcacaccagttgacaactccatggacagcaatatccatcaaaggcgaaattcatacagagggcatgagtcagaggacagcatgtctacactggctggaaggcgaggaatgagaccaaaaatgatgatgccctttgactcccagccaccccagcctgtgattagtgcccatcccatccattccctcgataaccctcaccatcatttccactccagcagcctcgcttctccagctcgcagtcatctctaccacccgggcagcccatggcccattggcacatccatgtccctttcagacagggccaattccacagaatccgttcgaaatacccccagcactgacaccatgccagcctcttcgtctcaaacatgctgcactgatcaccaggaccctgaaggtgctaccagctcctcttacttggccagctcccaagaggaagattcaggccagagtcttcccactgcccatgttcgcccttcccacccattgaagagcttcgccgtgccagcaatcccgcctccaggacctcccacctatgatcctgcattgccaagcacaccattactgtcccagcaagctctgaaccatcacattcactcagtgaagacagcctccatcgggactctaggaaggagccggcctcctatgccagtggttgttcccagtgcccctgaagtgcaggagaccacaaggatgttggaagactccgagagtagctatgaaccagatgagctgaccaaagagatggcccacctggaaggactaatgaaggacctaaacgctatcacaacagcatgacgaccttcaccaggacctgacttcaaacctgagtctggaagtcttggaacttacccttgaaaacaaggaattgtacagagtacgagaggacagcacttgagaacacagaatgagccagcagactggccagcgcctctgtgtagggctggctccaggcatggccacctgccttcccctggtcagcctggaagaagcctgtgtcgaggcagcttccctttgcctgctgatattctgcaggactgggcaccatgggccaaaattttgtgtccagggaagaggcgagaagtgcaacctgcatttcactttgtggtcaggccgtgtctttgtgctgtgactgcatcacctttatggagtgtagacattggcatttatgtacaattttatttgtgtcttattttattttaccttcaaaaacaaaaacgccatccaaaaccaaggaagtccttggtgttctccacaagtggttgacatttgactgcttgttccaattatgtatggaaagtctttgacagtgtgggtcgttcctggggttggcttgttttttggtttcatttttattttttaattctgagtcattgcatcctctaccagctgttaatccatcactctgagggggaggaaatgttgcattgctgtttgtaagctttttttattatttttttattataattattaaaggcctgactctttcctctcatcactgtgagattacagatctatttgaattgaatgaaatgtaacattgaaaagacttgtttgttgctttctgtgcagtttcagtattggggcgggtggggggctgggggttggtaataggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatcc

SEQ ID NO: 158308 - DNA, 2522 bp, Homo sapiens
  Payload ID: 10988
  Gene Symbol: NOV
  Gene Name: nephroblastoma overexpressed
  Uniprot ID: P48745
  ENST ID: ENST00000259526
  CDS Start-End: 228-1301
acagccaattgccatggcaaccccggggttcgttccacttccccacccagccgatctcccccctcctccctgcactgcagccaaccggcttgtgcgcgtcccaggagcgcgctataaaacctgtgctgggcgtgatcggcaagcaccggaccagggggaaggcgagcagtgccaatctacagcgaagaaagtctcgtttggtaaaagcgagaggggaaagcctgagcatgcagagtgtgcagagcacgagcttttgtctccgaaagcagtgcctttgcctgaccttcctgcttctccatctcctgggacaggtcgctgcgactcagcgctgccctccccagtgcccgggccggtgccctgcgacgccgccgacctgcgcccccggggtgcgcgcggtgctggacggctgctcatgctgtctggtgtgtgcccgccagcgtggcgagagctgctcagatctggagccatgcgacgagagcagtggcctctactgtgatcgcagcgcggaccccagcaaccagactggcatctgcacggcggtagagggagataactgtgtgttcgatggggtcatctaccgcagtggagagaaatttcagccaagctgcaaattccagtgcacctgcagagatgggcagattggctgtgtgccccgctgtcagctggatgtgctactgcctgagcctaactgcccagctccaagaaaagttgaggtgcctggagagtgctgtgaaaagtggatctgtggcccagatgaggaggattcactgggaggccttacccttgcagcttacaggccagaagccaccctaggagtagaagtctctgactcaagtgtcaactgcattgaacagaccacagagtggacagcatgctccaagagctgtggtatggggttctccacccgggtcaccaataggaaccgtcaatgtgagatgctgaaacagactcggctctgcatggtgcggccctgtgaacaagagccagagcagccaacagataagaaaggaaaaaagtgtctccgcaccaagaagtcactcaaagccatccacctgcagttcaagaactgcaccagcctgcacacctacaagcccaggttctgtggggtctgcagtgatggccgctgctgcactccccacaataccaaaaccatccaggcagagtttcagtgctccccagggcaaatagtcaagaagccagtgatggtcattgggacctgcacctgtcacaccaactgtcctaagaacaatgaggccttcctccaggagctggagctgaagactaccagagggaaaatgtaacctgtcactcaagaagcacacctacagagcacctgtagctgctgcgccacccaccatcaaaggaatataagaaaagtaatgaagaatcacgatttcatccttgaatcctatgtattttcctaatgtgatcatatgaggacctttatatctgtcttttatttaacaaaaaatgtaattaactgtaaacttggaatcaaggtaagctcaggatatggcttaggaatgacttactttcctgtggttttattacaaatgcaaatttctataaatttaagaaaacaagtatataatttactttgtagactgtttcacattgcactcatcatattttgttgtgcactagtgcaattccaagaaaatatcactgtaatgagtcagtgaagtctagaatcatacttaacatttcattgtacaagtattacaaccatatattgaggttcattgggaagattctctattggctccctttttgggtaaaccagctctgaacttccaagctccaaatccaaggaaacatgcagctcttcaacatgacatccagagatgactattacttttctgtttagttttacactaggaaacgtgttgtatctacagtaatgaaatgtttactaagtggactggtgtcataaactttctccatttaagacacattgactcctttccaatagaaagaaactaaacagaaaactcccaatacaaagatgactggtccctcatagccctcagacatttatatattggaagctgctgaggcccccaagttttttaattaagcagaaacagcatattagcagggattctctcatctaactgatgagtaaactgaggcccaaagcacttgcttacatcctctgatagctgtttcaaatgtgcattttgtggaattttgagaaaaatagagcaaaatcaacatgactggtggtgagagaccacacattttatgagagtttggaattattgtagacatgcccaaaacttatccttgggccataattatgaaaactcatgatcaagatatatgtgtatacatacatgtatctggtttgtcaggctacaaggtaggctgcaaaattaaatctagacattcttttaatgccaccacacgtgttccgcttctctcttttaaagtatttataaaaatataaattgtacattttgtaaaatattatgtttgatttctctacttgtcatatcactaaataaacacgattttattgc

SEQ ID NO: 158309 - DNA, 3003 bp, Homo sapiens
  Payload ID: 10989
  Gene Symbol: NPNT
  Gene Name: nephronectin
  Uniprot ID: Q6UXI9
  ENST ID: ENST00000305572
  CDS Start-End: 203-1732
gggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcagtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatgttaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaat

SEQ ID NO: 158310 - DNA, 4598 bp, Homo sapiens
  Payload ID: 10989
  Gene Symbol: NPNT
  Gene Name: nephronectin
  Uniprot ID: Q6UXI9
  ENST ID: ENST00000379987
  CDS Start-End: 217-1914
agctagaagggagcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcacttaagttagttctggcctgacctgaactctgacttttactgccattcactttataaaataagggtgtgtaacatatcaagatacatttatttttatctgttttttttttcctgttaaagacaattatgtagagtgggcacgtaatccctccttagtagtattgtgttttgtgtaaatgtgctattgatattaagtatttacatgttccaaatatttacagactctagttgcaaggtaaagggcagcttgtgatctcaaaaaaatacatggtgaaatgtcatccagttccatgaccttatattggcagcagtaggaaattggcagaagtgttgggttgtggtaacggagtgatgaatttttttttaatggccttgagtttgatctctgcaaaggataggaaacctttaggaagacaagaaactgcagttaatttagaactgtcactgtttcaagttacactttaaaaccacagcttttaccatcataacatggctctggtaatatgtaggaagctttataaaagttttggttgattcagaaaaaggatcctgttgcagagtgagaggaagcatagggggaaactccattggaacagattttcacacaacgttttaaattgatataagtttaggcagttgtagttcataacttatgttgctcatgttgtgctgtgtcaggatgggataggaagcaagtcccatgcttagaggcatgggatgtgttggaacgggatttacacacactggaggagcagggcaagttggaattctaagatccatgaacccccaactgtatttcctccctgcatattttaccaatatattaaaaaacaatgtaacttttaaaaggcatcattcctgaggtttgtcttaatttctgattaagtaatcagaatattttctgctatttttgccaggaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatgttaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaatacca

SEQ ID NO: 158311 - DNA, 2481 bp, Homo sapiens
  Payload ID: 10989
  Gene Symbol: NPNT
  Gene Name: nephronectin
  Uniprot ID: Q6UXI9
  ENST ID: ENST00000427316
  CDS Start-End: 213-2000
agaagggagcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagacgagcacatcccagctcctcttgaccaaggcagtgaacagcctcttttccaacccctggatcaccaagccacaagtttgccttcaagggatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcactta

SEQ ID NO: 158312 - DNA, 2419 bp, Homo sapiens
  Payload ID: 10989
  Gene Symbol: NPNT
  Gene Name: nephronectin
  Uniprot ID: Q6UXI9
  ENST ID: ENST00000453617
  CDS Start-End: 214-1962
tagaagggagcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctttctacgtcttaaggcagagaatagccaggataaggtgccagctcaaagctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtg

SEQ ID NO: 158313 - DNA, 1354 bp, Homo sapiens
  Payload ID: 10989
  Gene Symbol: NPNT
  Gene Name: nephronectin
  ENST ID: ENST00000504787
  CDS Start-End: 1-313
tggactttgtggatggatcagggagaaagacaatgacttgcactgggaaccaatcagggacccagcaggaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatgttaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaat

SEQ ID NO: 158314 - DNA, 2362 bp, Homo sapiens
  Payload ID: 10989
  Gene Symbol: NPNT
  Gene Name: nephronectin
  Uniprot ID: Q6UXI9
  ENST ID: ENST00000514622
  CDS Start-End: 213-1823
agaagggagcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcagtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcacttaagttagttctggcctgacctgaactctgacttttactgccattcactttataaaataa

SEQ ID NO: 158315 - DNA, 2187 bp, Homo sapiens
  Payload ID: 10989
  Gene Symbol: NPNT
  Gene Name: nephronectin
  Uniprot ID: Q6UXI9
  ENST ID: ENST00000506666
  CDS Start-End: 161-1861
gcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagacgagcacatcccagctcctcttgaccaaggcagtgaacagcctcttttccaacccctggatcaccaagccacaagtttgccttcaagggatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcagtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagc

SEQ ID NO: 158316 - DNA, 1829 bp, Homo sapiens
  Payload ID: 10989
  Gene Symbol: NPNT
  Gene Name: nephronectin
  ENST ID: ENST00000503451
  CDS Start-End: 1-1829
atggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctttctacgtcttaaggcagagaatagccaggataaggtgccagctcaaagctgtgtgccaaccacgatgcaaacatggtgaatgtatcgggccaaacaagtgcaagtgtcatcctggttatgctggaaaaacctgtaatcaagacgagcacatcccagctcctcttgaccaaggcagtgaacagcctcttttccaacccctggatcaccaagccacaagtttgccttcaagggatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctga

SEQ ID NO: 158317 - DNA, 353 bp, Homo sapiens
  Payload ID: 10989
  Gene Symbol: NPNT
  Gene Name: nephronectin
  ENST ID: ENST00000505917
  CDS Start-End: 1-80
acaatgacttgcactgggaaccaatcagggacccagcagacaattgtagctgtctgcatgcaggtggacttgacttgtagcaactggagacaaggtgtagttctccatgtgtctgagattccagaactagactcaattgtggttccagatcaaatcagcctgcagagaatggctgttccctggtgcacatggagttgagcggagcagcacacttgggcacaggggttggccgtcagctcactgtcctgctgccaccctccaccacctcagaggctgctgtaactttgagaaaataacctttgaacctcagtctctacaatgcttaaataaagagaacattcaattagagaaaa

SEQ ID NO: 158318 - DNA, 543 bp, Homo sapiens
  Payload ID: 10989
  Gene Symbol: NPNT
  Gene Name: nephronectin
  ENST ID: ENST00000504304
  CDS Start-End: 360-543
actcatccctagaggggcagtcctgtcctaatgtgctcgggagttgagctgatagagacagaaacagtctgctcatttcttcttcaaaacccgactggagagccaaatatttcttttggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggagga

SEQ ID NO: 158319 - DNA, 1377 bp, Homo sapiens
  Payload ID: 10989
  Gene Symbol: NPNT
  Gene Name: nephronectin
  ENST ID: ENST00000514837
  CDS Start-End: 1-1360
gtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcagagatccttcaaggaacacagttcagagagattttcatcgggtgcattctctctgcttcgtgtgtgacaagttatcttggctgctgagaaagagtgccctgccc

SEQ ID NO: 158320 - DNA, 3756 bp, Homo sapiens
  Payload ID: 10990
  Gene Symbol: NPHP1
  Gene Name: nephronophthisis 1 (juvenile)
  Uniprot ID: O15259
  ENST ID: ENST00000316534
  CDS Start-End: 75-2276
gatggcgtcaccttctggcgccgccggttggtttccctggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaacagataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaagtgatccatttgagaaagttgtatcacttaattcagtctgatacttgaatgtgatttacccctaattaagtacaaaaacagagtcgcttttgccttttcaaatcaagaaaataagtgctctgtcaaaagcacaaaaagaaactttcaggcactggagagtggagtcgactcaccctttcaggccttgttgcatctcagataaacctgtgactgctggtaaaataatgtcccaagcctttccttttagtgataaacagtagcagcctgcgttaattgagcacctactgtgtgtctgagcatttctcattagcccagttaatcctcacacctactgtaggagataggtactgttgttttttattaccgccgaagaaacaggccagataagtgaagtaatttgcctaaggtcacagctaataagtggcacagctaatattcccagtaaagataccatgtataattttctacaacctaagatgttctgccttatcggggcgaaccttttaggattccatgtgaaaataaaatatgaggaaaagtttaacctaaataattagaatcccattagaggtacttttttttgatggcatgctgccttaaaagagccatttatttttagagatctgtcatattatgaaagttctgggctatcttagctaacttatcctaaacccttaacctaaatttaacttgagccccagtctcagaaattaacatggtatgaaggtgtttccaggccaggcgcggtggctcacgcctgtaatcccaacactttgggaggccgaggtgggtggatcacctgaggtcaggagtttgagaccagcctggccaacactatctgtactaaaaacacaaaattagctgggcgtggtagtgcgtgcctgtaatcccagctacttgggaggctgaggtagaagaattgtttgaacctgggaggtggaggttgcagtgagccaagatcgtgccattgcactccagcctaggcaacaagagtgaaactccatctcaaaaaaaaaaaaaaaaaa

SEQ ID NO: 158321 - DNA, 1932 bp, Homo sapiens
  Payload ID: 10990
  Gene Symbol: NPHP1
  Gene Name: nephronophthisis 1 (juvenile)
  Uniprot ID: O15259
  ENST ID: ENST00000355301
  CDS Start-End: 5-1849
ggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagagataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaa

SEQ ID NO: 158322 - DNA, 2752 bp, Homo sapiens
  Payload ID: 10990
  Gene Symbol: NPHP1
  Gene Name: nephronophthisis 1 (juvenile)
  Uniprot ID: O15259
  ENST ID: ENST00000393272
  CDS Start-End: 99-2297
ggggctgggaggcgggcgcacatcgatggcgtcaccttctggcgccgccggttggtttccctggcaactggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagaggcgggcatcttctgtcttgttaatcatgtctcgttttgctacctaatagttctgatgcgaaataggatggagactgtggaagacaccaatggatctgaaacagggttcagggcatggaatgtacagagcagaggacgtatatttctggtttctaagcctgtgctccaaataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaa

SEQ ID NO: 158323 - DNA, 2513 bp, Homo sapiens
  Payload ID: 10990
  Gene Symbol: NPHP1
  Gene Name: nephronophthisis 1 (juvenile)
  Uniprot ID: O15259
  ENST ID: ENST00000445609
  CDS Start-End: 25-2058
aatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagagcagataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaatcactgtcactttacaacttaggttttactcttttctttctacagaccatatttttaaagaaatgtttatacaataatttaaatattttttaaaaccataaaataaatttttataaggaatactgttatatctaaatttaaacagtatttattttttcaaaaacagctacttaagttaatggtatagatttctataaaagcaagattttgtcaaaaactaaatttatgattattcaagaaagtgaaaaaaacaacctacagaatgggaaaacatatttgcaaatcatctaactgataaaggtctagtatccaaaatatttaaatttatgagtgttaataaaatttatcttgttcaatgaagaggaagttaaa

SEQ ID NO: 158324 - DNA, 357 bp, Homo sapiens
  Payload ID: 10990
  Gene Symbol: NPHP1
  Gene Name: nephronophthisis 1 (juvenile)
  ENST ID: ENST00000422492
  CDS Start-End: 1-143
atttaattagccatcccatgctggccaccttccccatgctcttggagcagcctgatgtgatggatgctctcaggagttcgtgggctggaaaagaaagcacattaaaaagatcagagaaggtaaaatatgagtctccacactgaactccatatttgcagtacctggtgtttgcttgcctattctaatcatgtctcttttttagcaaaagtagccatagtcataatccctcttaaccagggaaactgtttcattatggctgcaaaaacacattccaagagggttacgcatgatcgttagctaatgtgagaaggaatacttgttcaagacagccatttcagattactgagttttatttaa

SEQ ID NO: 158325 - DNA, 2246 bp, Homo sapiens
  Payload ID: 10990
  Gene Symbol: NPHP1
  Gene Name: nephronophthisis 1 (juvenile)
  ENST ID: ENST00000417665
  CDS Start-End: 28-2163
agcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgaagttggggcacctactgaagaagaggaagaaagtgaaagtgaagatagtgaagacagtggtggggaggaagaagatgcagaggaggaagaggaagagaaagaggaaaatgaatctcacaaatggtcaaccggtgaagaatacatcgctgttggagattttactgctcagcaagttggagatcttacatttaagaaaggggaaattctccttgtaattgaaaaaaaacctgatggttggtggatagctaaggatgccaaaggaaatgaaggtcttgttcccagaacctacctagagccttatagtgaagaagaagaaggccaagagtcaagtgaagagggcagtgaagaagatgtagaggcggtggatgaaacagcagatggagcagaagttaagcaaagaactgatccccactggagtgctgttcagaaagcgatttcagagataaacactgttgatgtgttaactacgatgggagctattcctgcagggttcaggccttccacgctctcacagcttctggaggaagggaatcaatttcgagcaaattacttcttacaaccagagctcatgccttcacaactggccttcagagatctgatgtgggatgctacagaaggcactattaggtcgagaccaagtcgtatttcattgattctgacattatggagctgtaaaatgattcctcttccaggaatgagcatacaggttctcagcagacatgtacgcctctgtctatttgatggtaataaggttctgagcaacattcatacagtcagagccacatggcaacctaaaaagcccaaaacatggaccttttctccccaggttactcgcatcttaccatgtttgcttgatggtgattgctttatcaggtctaattctgcatctccagatcttggaatattatttgaacttggaatttcttatattcgcaattcaactggtgaaagaggagagttaagctgtggctgggtgtttcttaaactttttgatgccagtggagttcctattccagcaaaaacttatgagcttttcttgaatggtggtactccttatgaaaaaggtattgaagtggacccttcaatatccagaagagcacacggcagtgttttctaccagattatgacaatgagaaggcagcctcaacttctagtgaaactgagatccttgaacagaagatcaagaaatgtactaagtctactgccagaaacattaattggaaatatgtgttctattcacttgttgatattttatcgacaaattcttggagatgtgctcctgaaagacaggatgagcttgcaaagtactgatttaattagccatcccatgctggccaccttccccatgctcttggagcagcctgatgtgatggatgctctcaggagttcgtgggctggaaaagaaagcacattaaaaagatcagagaagctctcaaagcctgtatcaccaagagaagggaaaaaaaaatggcctgagctgtaccatatattgaaaacaatgcattgctcctgcttaccttgctataaaatcatgagagacaaagagttcctgaagtccacgtttctcctggtttaccatgactgcgtgctcccacttctccactccacacgcctacccccattcaggtgggcagaagaagagactgagactgcacggtggaaagttatcactgacttccttaagcaaaaccaagaaaaccagggcgccctccaagctctgctgtcaccagacggagttcatgaaccttttgacctttcagagcagacctatgacttcttgggtgaaatgagaaagaatgcagtgtgacagtggcagcctctagccctcagcttcccacggaatcagatggatcctccacgattacgtgaataaaatgatggaaccaaaaa

SEQ ID NO: 158326 - DNA, 486 bp, Homo sapiens
  Payload ID: 10990
  Gene Symbol: NPHP1
  Gene Name: nephronophthisis 1 (juvenile)
  ENST ID: ENST00000449600
  CDS Start-End: 1-137
cgagacgacagcgagatcctctccaggccctgcggcgccgcaatcaggagctgaagcaacagaggacacctgaagctgaatatggaacagattttctattcggtgtctgtaggacaagtaatcaacagcccctctgagtcaggcctgtgatgactggctctatcactaggttgatagtttgctttctgagagccaactgaaagaagctctagaacccaataaaagacaacatatttatcaaagatgtatccagttaaagcaggcaatagatgaaaataaaaatgctcttcaaaaattaagcaaagtgaggaaattgaagctctcagtggtgaagcatccatgcctcttctgtcaataagtggcagaacttgggattggtgcctgtctcattgactttaaagccgatcttctgtcagaacatatctcttactgactatggaaggtctataatacttagcaagaaaataaaagagaaacctaaaacaa

SEQ ID NO: 158327 - DNA, 742 bp, Homo sapiens
  Payload ID: 10990
  Gene Symbol: NPHP1
  Gene Name: nephronophthisis 1 (juvenile)
  ENST ID: ENST00000418527
  CDS Start-End: 32-397
ctggagcaatcagagcaccgcagccagggagatgctggcgagacgacagcgagatcctctccaggccctgcggcgccgcaatcaggagctgaagcaacaggttgatagtttgctttctgagagccaactgaaagaagctctagaacccaataaaagacaacatatttatcaaagatgtatccagttaaagcaggcaatagatgaaaataaaaatgctcttcaaaaattaagcaaagctgatgaatctgcacctgttgcaaactataatcagagaaaagaagaggagcatactcttttggacaagcttacccaacaactgcagggccttgctgtgacaataagcagagaaaatataactgagtatgcttcctttctacctttcttttttcttttttaaagatatatcaccaatagctttaatgtttaactcaaagacatatagcagtatagatataaacaaatgacactaacaatagaatcagtcaacatttatttattgtgtataatagaaggtgttagatcccatgagagatggaaagaagtgtaagtcatagtctctgccctcaggcaatttataatttagttgaaacaaaacagagatctgaaaagctaaatgaacaaatgttagaaaataaagatgatatatttaatgtcaatgttgatgtgtaaaagggaaatgatttggaatgtctacttgcattgttctccctttcataaacattctttaaaaatttgaagcaaa

SEQ ID NO: 158328 - DNA, 4362 bp, Homo sapiens
  Payload ID: 10991
  Gene Symbol: NPHP3
  Gene Name: nephronophthisis 3 (adolescent)
  Uniprot ID: Q7Z494
  ENST ID: ENST00000337331
  CDS Start-End: 88-4080
gttccgttcctctgccccaccccgtcccgttccgttccgctgcccagtcctgctggtactcactaggtagtagcggcaacggacgccatggggaccgcctcgtcgctcgtgagccccgcgggcggggaagtgatcgaggacacgtacggggcgggcggcggcgaggcctgcgagatcccggtggaggtgaagcccaaggcccgcctgctgcgcaactcgttccgccgaggcgcgggggcggcagcaggggccgggcccgggtcgctgccccgcggggtgggcgcgggcgggctgctgggggccagcttcaagtccactggctcgtcggtgccagagctggagtacgcggcggccgagtacgagcggctcaggaaggagtacgagatctttcgcgtcagcaagaaccaggagttgttgtccatgggccgccgcgaggccaagctggacacggagaacaagcggctgcgggccgaactgcaggcacttcaaaaaacgtatcagaagatacttcgagaaaaagaaagtgctttagaagcgaaataccaagcaatggagagagcagcaacatttgaacatgacagagataaagttaaaaggcaattcaagatttttagggagaccaaagaaaatgaaattcaggacttactgagggccaagagggagttggagagcaaacttcagaggctacaggctcagggtatccaagtatttgatcctggggagtctgattcagatgacaactgtacagatgtcactgctgctggaacccaatgtgaatattggactggcggagccttgggaagtgaaccttccataggaagcatgatccagcttcagcagtccttcagaggccctgagtttgcccatagttctatagatgtggaaggaccctttgcaaatgttaatagagatgactgggatattgctgtagctagtttattacaagttactcctctgttttcacattctctgtggagtaacactgtcagatgttacctcatttatacagatgaaacccagcctgagatggatcttttccttaaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcagcaagttgaaaaacacatgaaatggctgatagatccactgccagtgaatgtaagagtaattgtttctgtgaatgtagaaacatgccctccagcatggaggttgtggcctacacttcatcttgatcccttaagtccaaaagatgcaaaatctattataattgcagaatgccactctgtagacattaaattgagtaaagagcaggagaagaagctagaacgacactgtcgttctgctacaacctgcaatgccctttatgtcacccttttcggcaaaatgatcgcgcgtgctgggagagcaggcaatttagataaaatccttcatcagtgtttccagtgtcaagatactctttcattatatagacttgttctgcactctatccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggaaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggtaatagcagcagttagaattctttgcaaatgtaccttaagacaaaataattaaacatttggaacatttgaatttgaaactttaaaaaaatgttgtacgaaattttactacgtgtgatttaactgctatttgtatgaagttgtattggattacattaagttggaattgtgattatgtctgttttagttgtttaaaagaattttcctattatatggtatccaaggatgtagacacattagaattataagaagacatgaggagcaaatcatgaagagcggattggtct

SEQ ID NO: 158329 - DNA, 1616 bp, Homo sapiens
  Payload ID: 10991
  Gene Symbol: NPHP3
  Gene Name: nephronophthisis 3 (adolescent)
  ENST ID: ENST00000469232
  CDS Start-End: 1-372
gccaagctggacacggagaacaagcggctgcgggccgaactgcaggcacttcaaaaaacgtatcagaagatacttcgagaaaaagaaagtgctttagaagcgaaataccaagcaatggagagagcagcaacatttgaacatgacagagataaagttaaaaggcaattcaagatttttagggagaccaaagaaaatgaaattcaggacttactgagggccaagagggagttggagagcaaacttcagaggctacaggctcagggtatccaagtatttgatcctggggagtctgattcagatgacaactgtacagatgtcactgtatcattggaatctgaccaacatcctggaatttttattgctaacttttaaggaaaaaaaatgaaggccgggcacggtggcttatgcctgtaataccagcactttgggaggccaaggcgggcggatcacgaggtcaaaagatcaagaccatcctggccaacatgctgctggaacccaatgtgaatattggactggcggagccttgggaagtgaaccttccataggaagcatgatccagcttcagcagtccttcagaggccctgagtttgcccatagttctatagatgtggaaggaccctttgcaaatgttaatagagatgactgggatattgctgtagctagtttattacaagttactcctctgttttcacattctctgtggagtaacactgtcagatgttacctcatttatacagatgaaacccagcctgagatggatcttttccttaaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctgg

SEQ ID NO: 158330 - DNA, 3852 bp, Homo sapiens
  Payload ID: 10991
  Gene Symbol: NPHP3
  Gene Name: nephronophthisis 3 (adolescent)
  ENST ID: ENST00000465756
  CDS Start-End: 50-1666
gctgcccagtcctgctggtactcactaggtagtagcggcaacggacgccatggggaccgcctcgtcgctcgtgagccccgcgggcggggaagtgatcgaggacacgtacggggcgggcggcggcgaggcctgcgagatcccggtggaggcacttcaaaaaacgtatcagaagatacttcgagaaaaagaaagtgctttagaagcgaaataccaagcaatggagagagcagcaacatttgaacatgacagagataaagttaaaaggcaattcaagatttttagggagaccaaagaaaatgaaattcaggacttactgagggccaagagggagttggagagcaaacttcagaggctacaggctcagggtatccaagtatttgatcctggggagtctgattcagatgacaactgtacagatgtcactgctgctggaacccaatgtgaatattggactggcggagccttgggaagtgaaccttccataggaagcatgatccagcttcagcagtccttcagaggccctgagtttgcccatagttctatagatgtggaaggaccctttgcaaatgttaatagagatgactgggatattgctgtagctagtttattacaagttactcctctgttttcacattctctgtggagtaacactgtcagatgttacctcatttatacagatgaaacccagcctgagatggatcttttccttaaggactattcacctaaacttaagagaatgtgcgagacaatgggatattttttccatgctgtttattttccaatagatgttgaaaatcaatacctcactgtaagaaaatgggaaattgagaaaagttctttagttattttatttattcacttaacattaccaagccttttattggaagactgtgaagaagcttttctgaaaaaccctgaaggaaaacctcgattaatctttcatcgtttggaagatggaaaagtcagttctgactctgtccagcaattgattgatcaagtttctaatctaaacaagaccagcaaagccaagatcattgatcactcaggagatcctgcagaaggagtatataaaacttatatttgtgtagaaaagattattaaacaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaatattaccaacgccttaatgatctagtggcagcaccagccccgattccacctcttctcgtgtctggaggaccaggttctgggaagtctcttcttttatcaaagtggattcaattacaacagaagaattcccccaacacactgattctttcccattttgtgggaaggcccatgtcaaccagctcagagtcctccttgattattaaacgactaactctaaagttgatgcagcactcttggtcagtctctgctctgacactggatcctgctaagcttctggaagaatttccacgttggctggaaaaactctctgctcgtcatcaaggcagcatcatcatcgttattgattctatagatcaagttcaggttgtggcctacacttcatcttgatcccttaagtccaaaagatgcaaaatctattataattgcagaatgccactctgtagacattaaattgagtaaagagcagtgctgggagagcaggcaatttagataaaatccttcatcagtgtttccagtgtcaagatactctttcattatatagacttgttctgcactctatccgggagtccatggcaaatgatgtggataaagagctaatgaagcagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggcttgggaaacagtgagattggagtacctggaaggccccactgttacttcttcatacaggcaaaagctaatcaactatttcaccttgcagctaagtcaggacagagtgacttggagaagtgcagatgaactcccgtggctttttcagcagcagggaagtaaacagaagctgcatgattgccttcttaatctctttgtgtctcaaaacctttataaaaggggacactttgctgagttgctgagttattggcagtttgttggcaaagacaaaagtgcaatggcaacagaatacttcgattcattgaagcagtatgagaaaaactgcgaaggcgaggacaacatgagttgcttagctgatctttatgaaaccttggggcgatttctcaaggatctaggccttctcagtcaggccatagtacctttgcagaggtctttagagattcgagaaacagctttagatcccgatcacccaagagtagcccagtccctccaccaactagcaagtgtatacgtgcagtggaagaagtttggcaatgcagaacaactgtataaacaggcgttggaaatctcagaaaatgcttatggtgcggaccatccatatactgctcgtgaacttgaagcacttgcaactttgtaccagaaacaaaataaatatgaacaagctgaacattttaggaaaaaatcctttaaaattcatcagaaagctataaagaaaaaaggcaacttgtacggatttgcccttttacgtagacgggctttacagttagaagagcttacattaggtaaggacacacctgataatgctcggaccctcaatgaactgggtgttctctactatcttcaaaataacctggaaacagctgaccagtttctgaagcgttccttagaaatgagggagcgagttctaggaccagatcaccctgactgtgctcagtctttgaataatctggcagctctatgcaatgaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgaaaaaacacgttgaagctttgccattatatgaaagagcattaaagatttatgaagatagcctgggtcggatgcatcctcgagttggagaaacactgaaaaatttagctgtgcttagctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggtaatagcagcagttagaattctttgcaaatgtaccttaagacaaaataattaaacatttggaacatttgaatttgaaactttaaaaaaatgttgtacgaaattttactacgtgtgatttaactgctatttgtatgaagttgtattggattacattaagttggaattgtgattatgtctgttttagttgtttaaaagaattttcctattatatggtatccaaggatgtagacacattagaattataagaagacatgaggagcaaatcatgaagagcggattggtctttg

SEQ ID NO: 158331 - DNA, 721 bp, Homo sapiens
  Payload ID: 10991
  Gene Symbol: NPHP3
  Gene Name: nephronophthisis 3 (adolescent)
  ENST ID: ENST00000512094
  CDS Start-End: 1-264
gaaaagaaacagtatgataaagcagaagaactttatgaaagagctttagatattcggagacgtgcattagctcctgatcacccttctttggcatatacggtgaagcatcttgccatcttgtataagaaaatggggaaacttgacaaagctgtacctttgtatgaattggctgttgaaattcgacagaaatcttttggcccaaagcaccctagtgtagctactgccttggtgaacttagctgttctttatagccaaatgctatgaaggaggagattttgaaaaagctgctgaattatacaaaagggcaatggaaataaaagaagcagaaacatcactcttgggtggaaaagctccttcacgccattcatcaagtggagacacgtttagcttaaaaacagctcattctcctaatgttttccttcagcaaggacaaaggtaatagcagcagttagaattctttgcaaatgtaccttaagacaaaataattaaacatttggaacatttgaatttgaaactttaaaaaaatgttgtacgaaattttactacgtgtgatttaactgctatttgtatgaagttgtattggattacattaagttggaattgtgattatgtctgttttagttgtttaaaagaattttcctattatatggtatccaaggatgtagacacattagaattataagaagacatgaggagcaaatcatgaagagcggattggtct

SEQ ID NO: 158332 - DNA, 4994 bp, Homo sapiens
  Payload ID: 10992
  Gene Symbol: NPHP4
  Gene Name: nephronophthisis 4
  Uniprot ID: O75161
  ENST ID: ENST00000378156
  CDS Start-End: 267-4547
gacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagatcatccgggaagcccacgggaccctcaggcgggcaggatgaacgactggcacaggatcttcacccaaaacgtgcttgtccctccccacccacagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggttgcggctgtaccatggcacccccagagccctcctgcacccgcttctccaggaccccgcagagcaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccggcgacgctctccgaaagcctcgcctccagaagcccatcacggggcacttggatgacttattcttcaccctgtacccctccctggagaagtttgaggaagagctgctggagctccacgtccaggaccacttccaggagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagcccgccagcgccagtacctcgagttctcgctgccccgcagaactcacctgtgggaccagggttgtcaatttcccagctggcggcctccccgcggtccccgactcagcactgcttggccaggcctacttcacagctaccccatggctctcaggcctccccggcccaggcacaggagttcccgttggaggccggtatctcccacctggaagccgacctgagccagacctccctggtcctggaaacatccattgccgaacagttacaggagctgccgttcacgcctttgcatgcccctattgttgtgggaacccagaccaggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggtcacccgtgtgaacagaaagtgagaggttgtagcacattgccaccgtccagatctcgggtcatctcaaacgatggagccagccgcttctctggaggcagcctcctcacgactggaagctcaaggcgaaaacacgtggtgcaagcacagaagctggcggacgtggacagtgagctggctgccatgctactgacccatgcccggcagggcaaggggccccaggacgtcagccgcgagtcggatgccacccgcaggcgtaagctggagcggatgaggtctgtgcgcctgcaggaggccgggggagacttgggccggcgcgggacgagcgtgttggcgcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctttgagtttgtgcttaagaacccccacaacacacagcacacggtgactgtggagatcgacaaccccgagctcagcgtcatcgtggacagtcaggagtggagggacttcaagggtgctgctggcctgcacacaccggtggaggaggacatgttccacctgcgtggcagcctggccccccagctctacctgcgcccccacgagaccgcccacgtccccttcaagttccagagcttctctgcagggcagctggccatggtgcaggcctctcctgggttgagcaacgagaagggcatggacgccgtgtcaccttggaagtccagcgcagtgcccactaaacacgccaaggtcttgttccgagcgagtggtggcaagcccatcgccgtgctctgcctgactgtggagctgcagccccacgtggtggaccaggtcttccgcttctatcacccggagctctccttcctgaagaaggccatccgcctgccgccctggcacacatttccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaagacagaccccaaaggtgtcttcgtgctgccgcctcgtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccctcctgccctgcaggctgtcctccccgcctctctgcagcctttcacttcagtgcccacctggctgacctgtgcacttggctgaggaagcagagaccgagcgctggtcattttgtagtacctgcatccagcttagctgctgctgacacccagcaggcctgggttccgtgagcgcgaactccgtggtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaactttt

SEQ ID NO: 158333 - DNA, 4213 bp, Homo sapiens
  Payload ID: 10992
  Gene Symbol: NPHP4
  Gene Name: nephronophthisis 4
  ENST ID: ENST00000378169
  CDS Start-End: 243-1031
agtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagatcatccgggaagcccacgggaccctcaggcgggcaggatgaacgactggcacaggatcttcacccaaaacgtgcttgtccctccccacccacagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggttgcggctgtaccatggcacccccagagccctcctgcacccgcttctccaggaccccgcagagcaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccgggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagagttcccgttggaggccggtatctcccacctggaagccgacctgagccagacctccctggtcctggaaacatccattgccgaacagttacaggagctgccgttcacgcctttgcatgcccctattgttgtgggaacccagaccaggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggtcacccgtgtgaacagaaagtgagaggttgtagcacattgccaccgtccagatctcgggtcatctcaaacgatggagccagccgcttctctggaggcagcctcctcacgactggaagctcaaggcgaaaacacgtggtgcaagcacagaagctggcggacgtggacagtgagctggctgccatgctactgacccatgcccggcagggcaaggggccccaggacgtcagccgcgagtcggatgccacccgcaggcgtaagctggagcggatgaggtctgtgcgcctgcaggaggccgggggagacttgggccggcgcgggacgagcgtgttggcgcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctttgagtttgtgcttaagaacccccacaacacacagcacacggtgactgtggagatcgacaaccccgagctcagcgtcatcgtggacagtcaggagtggagggacttcaagggtgctgctggcctgcacacaccggtggaggaggacatgttccacctgcgtggcagcctggccccccagctctacctgcgcccccacgagaccgcccacgtccccttcaagttccagagcttctctgcagggcagctggccatggtgcaggcctctcctgggttgagcaacgagaagggcatggacgccgtgtcaccttggaagtccagcgcagtgcccactaaacacgccaaggtcttgttccgagcgagtggtggcaagcccatcgccgtgctctgcctgactgtggagctgcagccccacgtggtggaccaggtcttccgcttctatcacccggagctctccttcctgaagaaggccatccgcctgccgccctggcacacatttccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaagacagaccccaaaggtgtcttcgtgctgccgcctcgtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtga

SEQ ID NO: 158334 - DNA, 5548 bp, Homo sapiens
  Payload ID: 10992
  Gene Symbol: NPHP4
  Gene Name: nephronophthisis 4
  Uniprot ID: O75161
  ENST ID: ENST00000489180
  CDS Start-End: 269-3004
gtgacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagatcatccgggaagcccacgggaccctcaggcgggcaggatgaacgactggcacaggatcttcacccaaaacgtgcttgtccctccccacccacagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggttgcggctgtaccatggcacccccagagccctcctgcacccgcttctccaggaccccgcagagcaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccggcgacgctctccgaaagcctcgcctccagaagcccatcacggggcacttggatgacttattcttcaccctgtacccctccctggagaagtttgaggaagagctgctggagctccacgtccaggaccacttccaggagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagcccgccagcgccagtacctcgagttctcgctgccccgcagaactcacctgtgggaccagggttgtcaatttcccagctggcggcctccccgcggtccccgactcagcactgcttggccaggcctacttcacagctaccccatggctctcaggcctccccggcccaggcagagttcccgttggaggccggtatctcccacctggaagccgacctgagccagacctccctggtcctggaaacatccattgccgaacagttacaggagctgccgttcacgcctttgcatgcccctattgttgtgggaacccagaccaggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggtcacccgtgtgaacagaaagtgagaggttgtagcacattgccaccgtccagatctcgggtcatctcaaacgatggagccagccgcttctctggaggcagcctcctcacgactggaagctcaaggcgctgggctctgcaggcgactgtgctgtttggagaagtgggaaccctgccagtggcatttgtgtctggttggctgctcatctgcaagggaaggagaaatggagagaaggtcaggaggaacatagactgattttcaaaacaagttgaagtaccctatgttgtgaacagaagaaagaagccaattatggagcttgggaaagaaagacctggtttggagaggaagacctgggtttggtgaaaatgtgtttcacagcagggaggctctgaagtttttctatccccttaaaatgaaaacacgtggtgcaagcacagaagctggcggacgtggacagtgagctggctgccatgctactgacccatgcccggcagggcaaggggccccaggacgtcagccgcgagtcggatgccacccgcaggcgtaagctggagcggatgaggtctgtgcgcctgcaggaggccgggggagacttgggccggcgcgggacgagcgtgttgtaaactcagcagggctgccactcagcctccctgccagcaaggcgttggtgctcaaaggtggatgcagacgcctcggtccctccctaggctcagttcagtctgatggggcgaggaagaggcatggtgagaagacacgggcacagcctgtcagaggttccactcctgaaaagctctgaggatgaaattctgatggaggccccaagtgtgaaaggccagctccaatccccctgcaaaggaacagccagagccttggatgttggaaagcgcagcagagcgtccgcacacagcacttgcgggacctacaggtcatcgccgcctaccgggaacgcacgaaggccgagagcatcgccagcctgctgagcctggccatcaccacggagcacacgctccacgccacgctgggggtcgccgagttctttgagtttgtgcttaagaacccccacaacacacagcacacggtgactgtggagatcgacaaccccgagctcagcgtcatcgtggacagtcaggagtggagggacttcaagggtgctgctggcctgcacacaccggtggaggaggacatgttccacctgcgtggcagcctggccccccagctctacctgcgcccccacgagaccgcccacgtccccttcaagttccagagcttctctgcagggcagctggccatggtgcaggcctctcctgggttgagcaacgagaagggcatggacgccgtgtcaccttggaagtccagcgcagtgcccactaaacacgccaaggtcttgttccgagcgagtggtggcaagcccatcgccgtgctctgcctgactgtggagctgcagccccacgtggtggaccaggtcttccgcttctatcacccggagctctccttcctgaagaaggccatccgcctgccgccctggcacacatttccaggtgctccggtgggaatgcttggtgaggaccccccagtccatgttcgctgcagcgacccgaacgtcatctgtgagacccagaatgtgggccccggggaaccacgggacatatttctgaaggtggccagtggtccaagcccggagatcaaagacttctttgtcatcatttactcggatcgctggctggcgacacccacacagacgtggcaggtctacctccactccctgcagcgcgtggatgtctcctgcgtcgcaggccagctgacccgcctgtcccttgtccttcgggggacacagacagtgaggaaagtgagagctttcacctctcatccccaggagctgaagacagaccccaaaggtgtcttcgtgctgccgcctcgtggggtgcaggacctgcatgttggcgtgaggccccttagggccggcagccgctttgtccatctcaacctggtggacgtggattgccaccagctggtggcctcctggctcgtgtgcctctgctgccgccagccgctcatctccaaggcctttgagatcatgttggctgcgggcgaagggaagggtgtcaacaagaggatcacctacaccaacccctacccctcccggaggacattccacctgcacagcgaccacccggagctgctgcggttcagagaggactccttccaggtcgggggtggagagacctacaccatcggcttgcagtttgcgcctagtcagagagtgggtgaggaggagatcctgatctacatcaatgaccatgaggacaaaaacgaagaggcattttgcgtgaaggtcatctaccagtgagggcttgagggtgacgtccttcctgcggcacccagctggggcctgtctgtgcccctcctgccctgcaggctgtcctccccgcctctctgcagcctttcacttcagtgcccacctggctgacctgtgcacttggctgaggaagcagagaccgagcgctggtcattttgtagtacctgcatccagcttagctgctgctgacacccagcaggcctgggttccgtgagcgcgaactccgtggtggtgggtctggctctggtgctgccatctacgcatgtgggaccctcgttatcgctgttgctcaaaatgtattttatgaatcatcctaaatgagaaaattatgtttttcttactggattttgtacaaacataatctattatttgctatgcaatattttatgctggtattatatctgttttttaaattgttgaacaaaatactaaacttttacacg

SEQ ID NO: 158335 - DNA, 1192 bp, Homo sapiens
  Payload ID: 10992
  Gene Symbol: NPHP4
  Gene Name: nephronophthisis 4
  ENST ID: ENST00000466897
  CDS Start-End: 1-415
cgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaaggagacttctcatatcttctcagtctcccagtgactgaggttccggaatcatcgatgtctatgcagtgatcgtatgcagtgtagacgagtgtggcaaagcgaccagggtctgcggcgaccggaagcccccagacccacaagggaagggtcagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggagagacttccctgtgcctcatgatggaggacagacaagggaagtgttcctaacttccctgcagcccgggaggaggagagtgaagaggcgcatttcttctcggcccagcaccatgactttgtagaaaatggtgccccgggattgctcgttagagggcctgagcaaagccctggacttcactccacgtccaggactgtggtgggtgggacaggtgggttgggtggctcaggagggtcccacctgggacgttccaggggcttcgactgaggcctatgctgggataggggctgctgatggggtgtcaagggacacaaggctgggtgcctgcctgtgcgcacctcagggcagaggaccgacatgggaccctgtagggccagtgacaagctcactgaacctcccgagggtcctctggaacgtttgggatttttcagggcagaattgaaaacacaataaaactaagccgtgtgatgtttctgaa

SEQ ID NO: 158336 - DNA, 3004 bp, Homo sapiens
  Payload ID: 10992
  Gene Symbol: NPHP4
  Gene Name: nephronophthisis 4
  Uniprot ID: O75161
  ENST ID: ENST00000622020
  CDS Start-End: 269-3004
gtgacgcgaggcgggttcttggactgagtgtgcggcgcggtgcgccgccttccgaggctcctcccgcgggtggcagcggacggggcgcgcccctcggccagtcctcggtcctcaggcttgtggctccgttgagcaccggccgccgggcctctgggtccgtcgagtggagactctctgaaaagcgtgggctccgtggcctccggcgcggccgcggcgggtcggtctcctagatcatccgggaagcccacgggaccctcaggcgggcaggatgaacgactggcacaggatcttcacccaaaacgtgcttgtccctccccacccacagagagcgcgccagccttggaaggaatccacggcattccagtgtgtcctcaagtggctggacggaccggtaattaggcagggcgtgctggaggtactgtcagaggttgaatgccatctgcgagtgtctttctttgatgtcacctaccggcacttctttgggaggacgtggaaaaccacagtgaagccgacgaagagaccgccgtccaggatcgtctttaatgagcccttgtattttcacacatccctaaaccaccctcatatcgtggctgtggtggaagtggtcgctgagggcaagaaacgggatgggagcctccagacattgtcctgtgggtttggaattcttcggatcttcagcaaccagccggactctcctatctctgcttcccaggacaaaaggttgcggctgtaccatggcacccccagagccctcctgcacccgcttctccaggaccccgcagagcaaaacagacacatgaccctcattgagaactgcagcctgcagtacacgctgaagccacacccggccctggagcctgcgttccaccttcttcctgagaaccttctggtgtctggtctgcagcagatacctggcctgcttccagctcatggagaatccggcgacgctctccgaaagcctcgcctccagaagcccatcacggggcacttggatgacttattcttcaccctgtacccctccctggagaagtttgaggaagagctgctggagctccacgtccaggaccacttccaggagggatgtggcccactggacggtggtgccctggagatcctggagcggcgcctgcgtgtgggcgtgcacaatggtctgggcttcgtgcagaggccgcaggtcgttgtactggtgcctgagatggatgtggccttgacgcgctcagctagcttcagcaggaaagtggtctcctcttccaagaccagctccgggagccaagctctggttttgagaagccgcctccgcctcccagagatggtcggccaccctgcatttgcggtcatcttccagctggagtacgtgttcagcagccctgcaggagtggacggcaatgcagcttcggtcacctctctgtccaacctggcatgcatgcacatggtccgctgggctgtttggaaccccttgctggaagctgattctggaagggtgaccctgcctctgcagggtgggatccagcccaacccctcgcactgtctggtctacaaggtaccctcagccagcatgagctctgaagaggtgaagcaggtggagtcgggtacactccggttccagttctcgctgggctcagaagaacacctggatgcacccacggagcctgtcagtggccccaaagtggagcggcggccttccaggaaaccacccacgtccccttcgagcccgccagcgccagtacctcgagttctcgctgccccgcagaactcacctgtgggaccagggttgtcaatttcccagctggcggcctccccgcggtccccgactcagcactgcttggccaggcctacttcacagctaccccatggctctcaggcctccccggcccaggcagagttcccgttggaggccggtatctcccacctggaagccgacctgagccagacctccctggtcctggaaacatccattgccgaacagttacaggagctgccgttcacgcctttgcatgcccctattgttgtgggaacccagaccaggagctctgcagggcagccctcgagagcctccatggtgctcctgcagtcctccggctttcccgagattctggatgccaataaacagccagccgaggctgtcagcgctacagaacctgtgacgtttaaccctcagaaggaagaatcagattgtctacaaagcaacgagatggtgctacagtttcttgcctttagcagagtggcccaggactgccgaggaacatcatggccaaagactgtgtatttcaccttccagttctaccgcttcccacccgcaacgacgccacgactgcagctggtccagctggatgaggccggccagcccagctctggcgccctgacccacatcctcgtgcctgtgagcagagatggcacctttgatgctgggtctcctggcttccagctgaggtacatggtgggccctgggttcctgaagccaggtgagcggcgctgctttgcccgctacctggccgtgcagaccctgcagattgacgtctgggacggagactccctgctgctcatcggatctgctgccgtccagatgaagcatctcctccgccaaggccggccggctgtgcaggcctcccacgagcttgaggtcgtggcaactgaatacgagcaggacaacatggtggtgagtggagacatgctggggtttggccgcgtcaagcccatcggcgtccactcggtggtgaagggccggctgcacctgactttggccaacgtgggtcacccgtgtgaacagaaagtgagaggttgtagcacattgccaccgtccagatctcgggtcatctcaaacgatggagccagccgcttctctggaggcagcctcctcacgactggaagctcaaggcgctgggctctgcaggcgactgtgctgtttggagaagtgggaaccctgccagtggcatttgtgtctggttggctgctcatctgcaagggaaggagaaatggagagaaggtcaggaggaacatagactga

SEQ ID NO: 158337 - DNA, 3741 bp, Homo sapiens
  Payload ID: 10993
  Gene Symbol: NPHS1
  Gene Name: nephrosis 1, congenital, Finnish type (nephrin)
  Uniprot ID: O60500
  ENST ID: ENST00000353632
  CDS Start-End: 2-3607
gatggccctggggacgacgctcagggcttctctcctgctcctggggctgctgactgaaggcctggcgcagttggcgattcctgcctccgttccccggggcttctgggccctgcctgaaaacctgacggtggtggagggggcctcagtggagctgcgttgtggggtcagcacccctggcagtgcggtgcaatgggccaaagatgggctgctcctgggccccgaccccaggatcccaggcttcccgaggtaccgcctggaaggggaccctgctagaggtgaattccacctgcacatcgaggcctgtgacctcagcgatgacgcggagtatgagtgccaggtcggccgctctgagatggggcccgagctcgtgtctcccagagtgatcctctccatcctggttcctcccaagctgctcctgctgaccccagaggcaggcaccatggtcacctgggtagctgggcaggagtacgtggtcaactgtgtgtctggggacgcgaagccagcacctgacatcaccattctcctgagtggacagacaatatctgacatctctgcaaacgtgaacgagggctcccagcagaaactcttcactgtggaggccacagccagggtgacaccccggagctcagataataggcagttgctggtctgtgaggcgtctagcccagcactggaggcccccatcaaggcctcattcaccgtgaatgttctgttccctccaggaccccctgtcatcgagtggccaggcctggatgaggggcacgtgcgggcaggacagagcttggagctgccgtgcgtggcccgagggggtaatcccttagccacactgcagtggctgaagaatggccagccggtgtccacagcgtggggcacagagcacacccaggcggtggcccgcagtgtgctggtgatgaccgtgaggccagaagaccatggagcgcagctcagctgcgaggcccacaacagcgtgtctgcagggacccaggagcacggcatcacactgcaggtcacctttccccctagtgccattattatcttgggatctgcatcccagactgagaacaagaacgtgacactctcctgtgtcagcaagtccagtcgcccgcgggttctgctacgatggtggctgggctggcggcagctgctgcccatggaggagacagtcatggatggactgcatggcggtcacatctccatgtccaacctgacattcctggcgcggcgggaggacaacggtctgaccctcacatgtgaggccttcagtgaagccttcaccaaggagaccttcaagaagtcgctcatcctgaacgtaaaatatcccgcccagaaactgtggattgagggtcccccagagggccagaagctccgggctgggacccgggtgaggctggtgtgtttggctatcgggggcaacccagagccctccctcatgtggtacaaggactcgcgcaccgtgaccgagtcgcggctgccgcaggagtcgcggcgcgtgcatctcggcagcgtggagaaatctgggagcaccttctcccgagagctggtgctggtcacagggccgtcggacaaccaggccaagttcacgtgcaaggctggacagctcagcgcgtccacgcagctggcggtgcagtttcccccaactaacgtgacgatcctggccaacgcatccgcactgcgcccgggagacgccttaaacttgacatgcgtcagcgtcagcagcaatccgccggtcaacttgtcctgggacaaggaaggggagaggctggagggcgtggccgccccaccccggagagccccattcaaaggctccgccgccgccaggagcgtccttctgcaagtgtcatcccgcgatcatggccagcgcgtgacctgccgcgcccacagcgccgagctccgcgaaaccgtgagctccttctatcgcctcaacgtactgtaccgtccagagttcctgggggagcaggtgctggtggtgaccgcggtggagcagggcgaggcgttgctgcccgtgtccgtgtccgctaaccccgcccccgaggccttcaactggaccttccgcggctatcgcctcagtccagcgggcggcccccggcatcgcatcctgtccagcggggctctgcatctgtggaatgtgacccgcgcggacgacggcctctatcagctgcactgccagaactctgagggcaccgcggaagcgcggctgcggctggacgtgcactatgctcccaccatccgtgccctccaggaccccactgaggtgaacgtcgggggttctgtggacatagtctgcactgtcgatgccaatcccatcctcccgggcatgttcaactgggagagactgggagaagatgaggaggaccagagcctggatgacatggagaagatatccaggggaccaacggggcgcctgcggattcaccatgccaaactggcccaggctggcgcttaccagtgcattgtggacaatggggtggcgcctccagcacgacggctgctccgtcttgttgtcagatttgccccccaggtggagcaccccactcccctaactaaggtggctgcagctggagacagcaccagttctgccaccctccactgccgtgcccgaggtgtccccaacatcgttttcacttggacaaaaaacggggtccctctggatctccaagatcccaggtacacggagcacacataccaccagggtggtgtccacagcagcctcctgaccattgccaacgtgtctgccgcccaggattacgccctcttcacatgtacagccaccaacgcccttggctcggaccaaaccaacattcaacttgtcagcatcagccgccctgaccctccatcaggattaaaggttgtgagtctgaccccacactccgtggggctggagtggaagcctggctttgatgggggcctgccacagaggttctgcatcaggtatgaggccctggggactccagggttccactatgtggatgtcgtaccaccccaggccaccaccttcacgctgactggtctacagccttctacaagatacagggtctggctgctggccagtaatgccttgggggacagtggactggctgacaaagggacccagcttcccatcactaccccaggtctccaccagccttctggagaacctgaagaccagctgcccacagagccaccttcaggcatctcagagaagacagaggcagggtcggaagaggaccgagtcaggaacgaatatgaggagagccagtggacaggagagcgggacactcagagctccacggtcagcacaacagaggcagagccgtattaccgctccctgagggacttcagcccccagctgcccccgacgcaggaggaggtgtcttattcccgaggtttcacaggtgaagatgaggatatggccttccctgggcacttgtatgatgaggtagaaagaacgtaccccccgtctggagcctggggacccctctacgatgaagtgcagatgggaccctgggacctccactggcctgaagacacatatcaggatccaagaggaatctatgaccaggtggccggagacttggacactctggaacccgattctctgcccttcgagctgaggggacatctggtgtaagagccctctcaaccccattgtcctgcacctgcaggaatttacactccactggtctctctcattacagcctgggccgagctggttaggtgagctccataaaacccaaagggacttggtgtcaggagaggacatgg

SEQ ID NO: 158338 - DNA, 4276 bp, Homo sapiens
  Payload ID: 10993
  Gene Symbol: NPHS1
  Gene Name: nephrosis 1, congenital, Finnish type (nephrin)
  Uniprot ID: O60500
  ENST ID: ENST00000378910
  CDS Start-End: 1-3726
atggccctggggacgacgctcagggcttctctcctgctcctggggctgctgactgaaggcctggcgcagttggcgattcctgcctccgttccccggggcttctgggccctgcctgaaaacctgacggtggtggagggggcctcagtggagctgcgttgtggggtcagcacccctggcagtgcggtgcaatgggccaaagatgggctgctcctgggccccgaccccaggatcccaggcttcccgaggtaccgcctggaaggggaccctgctagaggtgaattccacctgcacatcgaggcctgtgacctcagcgatgacgcggagtatgagtgccaggtcggccgctctgagatggggcccgagctcgtgtctcccagagtgatcctctccatcctggttcctcccaagctgctcctgctgaccccagaggcaggcaccatggtcacctgggtagctgggcaggagtacgtggtcaactgtgtgtctggggacgcgaagccagcacctgacatcaccattctcctgagtggacagacaatatctgacatctctgcaaacgtgaacgagggctcccagcagaaactcttcactgtggaggccacagccagggtgacaccccggagctcagataataggcagttgctggtctgtgaggcgtctagcccagcactggaggcccccatcaaggcctcattcaccgtgaatgttctgttccctccaggaccccctgtcatcgagtggccaggcctggatgaggggcacgtgcgggcaggacagagcttggagctgccgtgcgtggcccgagggggtaatcccttagccacactgcagtggctgaagaatggccagccggtgtccacagcgtggggcacagagcacacccaggcggtggcccgcagtgtgctggtgatgaccgtgaggccagaagaccatggagcgcagctcagctgcgaggcccacaacagcgtgtctgcagggacccaggagcacggcatcacactgcaggtcacctttccccctagtgccattattatcttgggatctgcatcccagactgagaacaagaacgtgacactctcctgtgtcagcaagtccagtcgcccgcgggttctgctacgatggtggctgggctggcggcagctgctgcccatggaggagacagtcatggatggactgcatggcggtcacatctccatgtccaacctgacattcctggcgcggcgggaggacaacggtctgaccctcacatgtgaggccttcagtgaagccttcaccaaggagaccttcaagaagtcgctcatcctgaacgtaaaatatcccgcccagaaactgtggattgagggtcccccagagggccagaagctccgggctgggacccgggtgaggctggtgtgtttggctatcgggggcaacccagagccctccctcatgtggtacaaggactcgcgcaccgtgaccgagtcgcggctgccgcaggagtcgcggcgcgtgcatctcggcagcgtggagaaatctgggagcaccttctcccgagagctggtgctggtcacagggccgtcggacaaccaggccaagttcacgtgcaaggctggacagctcagcgcgtccacgcagctggcggtgcagtttcccccaactaacgtgacgatcctggccaacgcatccgcactgcgcccgggagacgccttaaacttgacatgcgtcagcgtcagcagcaatccgccggtcaacttgtcctgggacaaggaaggggagaggctggagggcgtggccgccccaccccggagagccccattcaaaggctccgccgccgccaggagcgtccttctgcaagtgtcatcccgcgatcatggccagcgcgtgacctgccgcgcccacagcgccgagctccgcgaaaccgtgagctccttctatcgcctcaacgtactgtaccgtccagagttcctgggggagcaggtgctggtggtgaccgcggtggagcagggcgaggcgttgctgcccgtgtccgtgtccgctaaccccgcccccgaggccttcaactggaccttccgcggctatcgcctcagtccagcgggcggcccccggcatcgcatcctgtccagcggggctctgcatctgtggaatgtgacccgcgcggacgacggcctctatcagctgcactgccagaactctgagggcaccgcggaagcgcggctgcggctggacgtgcactatgctcccaccatccgtgccctccaggaccccactgaggtgaacgtcgggggttctgtggacatagtctgcactgtcgatgccaatcccatcctcccgggcatgttcaactgggagagactgggagaagatgaggaggaccagagcctggatgacatggagaagatatccaggggaccaacggggcgcctgcggattcaccatgccaaactggcccaggctggcgcttaccagtgcattgtggacaatggggtggcgcctccagcacgacggctgctccgtcttgttgtcagatttgccccccaggtggagcaccccactcccctaactaaggtggctgcagctggagacagcaccagttctgccaccctccactgccgtgcccgaggtgtccccaacatcgttttcacttggacaaaaaacggggtccctctggatctccaagatcccaggtacacggagcacacataccaccagggtggtgtccacagcagcctcctgaccattgccaacgtgtctgccgcccaggattacgccctcttcacatgtacagccaccaacgcccttggctcggaccaaaccaacattcaacttgtcagcatcagccgccctgaccctccatcaggattaaaggttgtgagtctgaccccacactccgtggggctggagtggaagcctggctttgatgggggcctgccacagaggttctgcatcaggtatgaggccctggggactccagggttccactatgtggatgtcgtaccaccccaggccaccaccttcacgctgactggtctacagccttctacaagatacagggtctggctgctggccagtaatgccttgggggacagtggactggctgacaaagggacccagcttcccatcactaccccaggtctccaccagccttctggagaacctgaagaccagctgcccacagagccaccttcaggaccctcggggctgcccctgctgcctgtgctgttcgctcttggggggcttctgctcctctccaatgcctcctgtgtcgggggggtcctctggcagcggagactcaggcgtcttgctgagggcatctcagagaagacagaggcagggtcggaagaggaccgagtcaggaacgaatatgaggagagccagtggacaggagagcgggacactcagagctccacggtcagcacaacagaggcagagccgtattaccgctccctgagggacttcagcccccagctgcccccgacgcaggaggaggtgtcttattcccgaggtttcacaggtgaagatgaggatatggccttccctgggcacttgtatgatgaggtagaaagaacgtaccccccgtctggagcctggggacccctctacgatgaagtgcagatgggaccctgggacctccactggcctgaagacacatatcaggatccaagaggaatctatgaccaggtggccggagacttggacactctggaacccgattctctgcccttcgagctgaggggacatctggtgtaagagccctctcaaccccattgtcctgcacctgcaggaatttacactccactggtctctctcattacagcctgggccgagctggttaggtgagctccataaaacccaaagggacttggtgtcaggagaggacatggagggggctgagtgacagagatggttcagctggtaccagagtagaaacaaggtgcatcctggggttggctttagaaactaaacttctccaaaaggacagggcagattgtaaacgtcgtctcaaaaatgaaatgctgccgggtgcggtgactcacgcctataatcccagcactttgggaggctgaggcgggtggatcacctgaggtcaggagttcgagaccagcctggccaacatggtaaaactccatttctactaaaaatataaaaaattagccaggagtagtggcgcatgcctgtagtcccagctacttgggaggctgatgcatgagaattgcttgaacccaggaggcggaggttgcagtgagctgagatcacgccactgcactccagcctgggcgacagagcgagattctgtctc

SEQ ID NO: 158339 - DNA, 1855 bp, Homo sapiens
  Payload ID: 10994
  Gene Symbol: NPHS2
  Gene Name: nephrosis 2, idiopathic, steroid-resistant (podocin)
  Uniprot ID: Q9NP85
  ENST ID: ENST00000367615
  CDS Start-End: 70-1221
cacagggactgcgctcccgtgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcggaggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggtcttttcttttttttgccctgcctggatacctaccacaaggttgaccttcgtctccaaactctggagataccttttcatgagatcgtgaccaaagacatgtttataatggagatagatgccatttgctactaccgaatggaaaatgcctctcttctcctaagcagtcttgctcatgtatctaaagctgtgcaattccttgtgcaaaccactatgaagcgtctcctagcacatcgatccctcactgaaattcttctagagaggaagagcatcgcccaagatgcaaaggttgccttggattcagtgacctgtatttggggaatcaaagtggagagaatagaaattaaagatgtgaggttgccagctgggcttcagcactcactggctgtggaggctgaagcgcaaagacaagccaaagtgcggatgattgctgcagaagcggaaaaggctgcttctgagtccctgaggatggcagctgagattctgtcaggcacccctgctgccgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatgcctgagggagacactctgtcctcattccctgcccttcctttggttgccatatggaatggccatggaatgcacgaagtcacaatgcaccatccatgagaagacggtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccaaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaaggaa

SEQ ID NO: 158340 - DNA, 1670 bp, Homo sapiens
  Payload ID: 10994
  Gene Symbol: NPHS2
  Gene Name: nephrosis 2, idiopathic, steroid-resistant (podocin)
  Uniprot ID: Q9NP85
  ENST ID: ENST00000367616
  CDS Start-End: 89-1036
cgcggacccgcagcgactccacagggactgcgctcccgtgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcggaggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggtcttttcttttttttgccctgcctggatacctaccacaaggttgaccttcgtctccaaactctggagataccttttcatgaggttgccttggattcagtgacctgtatttggggaatcaaagtggagagaatagaaattaaagatgtgaggttgccagctgggcttcagcactcactggctgtggaggctgaagcgcaaagacaagccaaagtgcggatgattgctgcagaagcggaaaaggctgcttctgagtccctgaggatggcagctgagattctgtcaggcacccctgctgccgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatgcctgagggagacactctgtcctcattccctgcccttcctttggttgccatatggaatggccatggaatgcacgaagtcacaatgcaccatccatgagaagacggtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccaaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaaggaa

SEQ ID NO: 158341 - DNA, 1047 bp, Homo sapiens
  Payload ID: 10995
  Gene Symbol: NGF
  Gene Name: nerve growth factor (beta polypeptide)
  Uniprot ID: P01138
  ENST ID: ENST00000369512
  CDS Start-End: 170-895
agagagcgctgggagccggaggggagcgcagcgagttttggccagtggtcgtgcagtccaaggggctggatggcatgctggacccaagctcagctcagcgtccggacccaataacagttttaccaagggagcagctttctatcctggccacactgaggtgcatagcgtaatgtccatgttgttctacactctgatcacagcttttctgatcggcatacaggcggaaccacactcagagagcaatgtccctgcaggacacaccatcccccaagcccactggactaaacttcagcattcccttgacactgcccttcgcagagcccgcagcgccccggcagcggcgatagctgcacgcgtggcggggcagacccgcaacattactgtggaccccaggctgtttaaaaagcggcgactccgttcaccccgtgtgctgtttagcacccagcctccccgtgaagctgcagacactcaggatctggacttcgaggtcggtggtgctgcccccttcaacaggactcacaggagcaagcggtcatcatcccatcccatcttccacaggggcgaattctcggtgtgtgacagtgtcagcgtgtgggttggggataagaccaccgccacagacatcaagggcaaggaggtgatggtgttgggagaggtgaacattaacaacagtgtattcaaacagtacttttttgagaccaagtgccgggacccaaatcccgttgacagcgggtgccggggcattgactcaaagcactggaactcatattgtaccacgactcacacctttgtcaaggcgctgaccatggatggcaagcaggctgcctggcggtttatccggatagatacggcctgtgtgtgtgtgctcagcaggaaggctgtgagaagagcctgacctgccgacacgctccctccccctgccccttctacactctcctgggcccctccctacctcaacctgtaaattattttaaattataaggactgcatggtaatttatagtttatacagttttaaagaatcattatttattaaatttttggaagc

SEQ ID NO: 158342 - DNA, 3417 bp, Homo sapiens
  Payload ID: 10996
  Gene Symbol: NGFR
  Gene Name: nerve growth factor receptor
  Uniprot ID: P08138
  ENST ID: ENST00000172229
  CDS Start-End: 126-1409
agagcgagccgagccgcggccagctccggcgggcagggggggcgctggagcgcagcgcagcgcagccccatcagtccgcaaagcggaccgagctggaagtcgagcgctgccgcgggaggcgggcgatgggggcaggtgccaccggccgcgccatggacgggccgcgcctgctgctgttgctgcttctgggggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtactagggggaagtgacaaggccccagagactcagagggaggaatcgaggaaccagagccatggactctacactgtgaacttggggaacaagggtggcatcccagtggcctcaaccctccctcagcccctcttgccccccaccccagcctaagatgaagaggatcggaggcttgtcagagctgggaggggttttcgaagctcagcccacccccctcattttggatataggtcagtgaggcccagggagaggccatgattcgcccaaagccagacagcaacggggaggccaagtgcaggctggcaccgccttctctaaatgaggggcctcaggtttgcctgagggcgaggggagggtggcaggtgaccttctgggaaatggcttgaagccaagtcagctttgccttccacgctgtctccagacccccaccccttccccactgcctgcccacccgtggagatgggatgcttgcctagggcctggtccatgatggagtcaggtttggggttcgtggaaagggtgctgcttccctctgcctgtccctctcaggcatgcctgtgtgacatcagtggcatggctccagtctgctgccctccatcccgacatggacccggagctaacactggcccctagaatcagcctaggggtcagggaccaaggacccctcaccttgcaacacacagacacacgcacacacacacacaggaggagaaatctcacttttctccatgagttttttctcttgggctgagactggatactgcccggggcagctgccagagaagcatcggagggaattgaggtctgctcggccgtcttcactcgcccccgggtttggcgggccaaggactgccgaccgaggctggagctggcgtctgtcttcaagggcttacacgtggaggaatgctcccccatcctccccttccctgcaaacatggggttggctgggcccagaaggttgtgatgaagaaaagtgggccagtgtgggaatgcggcaagaaggaattgacttcgactgtgacctgtggggatttctcccagctctagacaaccctgcaaaggactgttttttcctgagcttggccagaagggggccatgaggcctcagtggactttccaccccctccctggcctgttctgttttgcctgaagttggagtgagtgtggctcccctctatttagcatgacaagccccaggcaggctgtgcgctgacaaccaccgctccccagcccagggttcccccagccctgtggaagggactaggagcactgtagtaaatggcaattctttgacctcaacctgtgatgaggggaggaaactcacctgctggcccctcacctgggcacctggggagtgggacagagtctgggtgtatttattttcctccccagcaggtggggagggggtttgggggcttgcaagtatgttttagcatgtgtttggttctggggcccctttttactccccttgagctgagatggaacccttttggcccccgagctgggggccatgagctccagacccccagcaaccctcctatcacctcccctccttgcctcctgtgtaatcatttcttgggccctcctgaaacttacacacaaaacgttaagtgatgaacattaaatagcaaagaaagaaaaatagtacaaa

SEQ ID NO: 158343 - DNA, 703 bp, Homo sapiens
  Payload ID: 10996
  Gene Symbol: NGFR
  Gene Name: nerve growth factor receptor
  ENST ID: ENST00000509200
  CDS Start-End: 691-703
gagtctggggctgcgcgccgctccccacctagctgcgcgacccgagcgccgcgcccaccgcgctccgtgggctcccgcgcctcgaagggtcgggatccggtctgagcctctcctggctctcggtgcaagccgctgggcacctaacgagacgggggcgcccggacgcctcggattctgtagcgcggtatcccgggccaccgactcggcaaaggtcggcgggtcctccgggtggtccgacgagattgtcagatgtggcctgctttatggccatgaaccgaatgccctggaaggtctggcaacggaggaggcgtcttcactctccccgccagcatctttcatcagagcactgcgccccaaattccggctttacagatacggagactgaggctctgagagtttaaacgacttggccaagatctcacagcaagttgggccagagtcgtggctagactccccgacctgattcccagctcggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgt

SEQ ID NO: 158344 - DNA, 1840 bp, Homo sapiens
  Payload ID: 10996
  Gene Symbol: NGFR
  Gene Name: nerve growth factor receptor
  Uniprot ID: P08138
  ENST ID: ENST00000504201
  CDS Start-End: 476-1477
gtagaccaggagagcggggaggagggaccggatcccagaggggcaacgacttgggctccgggtctgggcaagagcgagggtccccgcgcgaagacccaaggaaggaggggagctgggcgtggaggacctgggcgcttgggaaggtgtaccccgacaggaacctgccgtctgcagcccctgcggctcccgcctccgcctcggcgcgcggctgctcggtctgggatggctgtgcgcggtccgagtttcttcctgggccgcggtgtcccttggaggtgccaaggaggcatgccccacaggcctgtacacacacagcggtgagtgctgcaaagcctgcaacctgggcgagggtgtggcccagccttgtggagccaaccagaccgtgtgtgagccctgcctggacagcgtgacgttctccgacgtggtgagcgcgaccgagccgtgcaagccgtgcaccgagtgcgtggggctccagagcatgtcggcgccgtgcgtggaggccgacgacgccgtgtgccgctgcgcctacggctactaccaggatgagacgactgggcgctgcgaggcgtgccgcgtgtgcgaggcgggctcgggcctcgtgttctcctgccaggacaagcagaacaccgtgtgcgaggagtgccccgacggcacgtattccgacgaggccaaccacgtggacccgtgcctgccctgcaccgtgtgcgaggacaccgagcgccagctccgcgagtgcacacgctgggccgacgccgagtgcgaggagatccctggccgttggattacacggtccacacccccagagggctcggacagcacagcccccagcacccaggagcctgaggcacctccagaacaagacctcatagccagcacggtggcaggtgtggtgaccacagtgatgggcagctcccagcccgtggtgacccgaggcaccaccgacaacctcatccctgtctattgctccatcctggctgctgtggttgtgggccttgtggcctacatagccttcaagaggtggaacagctgcaagcagaacaagcaaggagccaacagccggccagtgaaccagacgcccccaccagagggagaaaaactccacagcgacagtggcatctccgtggacagccagagcctgcatgaccagcagccccacacgcagacagcctcgggccaggccctcaagggtgacggaggcctctacagcagcctgcccccagccaagcgggaggaggtggagaagcttctcaacggctctgcgggggacacctggcggcacctggcgggcgagctgggctaccagcccgagcacatagactcctttacccatgaggcctgccccgttcgcgccctgcttgcaagctgggccacccaggacagcgccacactggacgccctcctggccgccctgcgccgcatccagcgagccgacctcgtggagagtctgtgcagtgagtccactgccacatccccggtgtgagcccaaccggggagcccccgccccgccccacattccgacaaccgatgctccagccaacccctgtggagcccgcacccccaccctttggggggggcccgcctggcagaactgagctcctctgggcaggacctcagagtccaggccccaaaaccacagccctgtcagtgcagcccgtgtggccccttcacttctgaccacacttcctgtccagagagagaagtgcccctgctgcctccccaaccctgcccctgccccgtcaccatctcaggccacctgcccccttctcccacactgctaggtgggccagcccctcccaccacagcaggtgtcatatatggggggccaacaccagggatggtacta

SEQ ID NO: 158345 - DNA, 921 bp, Homo sapiens
  Payload ID: 10997
  Gene Symbol: NGFRAP1
  Gene Name: nerve growth factor receptor (TNFRSF16) associated protein 1
  Uniprot ID: Q00994
  ENST ID: ENST00000361298
  CDS Start-End: 366-671
ggctgtgcgctctggggcacctcatgcagacgggagtagggaggctgttttttgcgcgtgcatatggcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatcta

SEQ ID NO: 158346 - DNA, 753 bp, Homo sapiens
  Payload ID: 10997
  Gene Symbol: NGFRAP1
  Gene Name: nerve growth factor receptor (TNFRSF16) associated protein 1
  Uniprot ID: Q00994
  ENST ID: ENST00000372634
  CDS Start-End: 204-509
gaggggagcccgggctcggagcacggaaagggccgggcggcggcgggtcttcgctagcgttccgctgcagcagcccccaccccccacaacccccaccccggctcgactgcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagc

SEQ ID NO: 158347 - DNA, 805 bp, Homo sapiens
  Payload ID: 10997
  Gene Symbol: NGFRAP1
  Gene Name: nerve growth factor receptor (TNFRSF16) associated protein 1
  Uniprot ID: Q00994
  ENST ID: ENST00000372635
  CDS Start-End: 237-572
cggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagca

SEQ ID NO: 158348 - DNA, 913 bp, Homo sapiens
  Payload ID: 10997
  Gene Symbol: NGFRAP1
  Gene Name: nerve growth factor receptor (TNFRSF16) associated protein 1
  Uniprot ID: Q00994
  ENST ID: ENST00000372645
  CDS Start-End: 328-663
gcgtgcatatggcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatcta

SEQ ID NO: 158349 - DNA, 2563 bp, Homo sapiens
  Payload ID: 10998
  Gene Symbol: NHLH1
  Gene Name: nescient helix loop helix 1
  Uniprot ID: Q02575
  ENST ID: ENST00000302101
  CDS Start-End: 447-848
aggtgtgtgtgtctgagggtgtgtgtgtgagtgtggctggccccagtacctggccaagcccaccacttccacctgggccctacacccccacaatgtgtacccctcttatctgccctggagcctgtacagccatgccacgctacccctgagagtctagaaagctggtcactaactttgcagacggatgagccttgagcacccagaggagactggggctgtcaacgctgccccttgtcctgccggcttggatcccctgacagggtccttctaggcttcagactggcaccctgaccatggaaccctgaagtggcagtgacttctagagctcagtggcagaccccacgacccttcctcccccttcctccccctcccaccaccagctttcaagctcccagagggaggggtggggaggggatcctgatctcacagggcagggggcttccatcatgatgctcaactcagacaccatggagctggacctgccgcccacccactcagagactgagtcgggcttcagtgactgtgggggcggggcgggccctgatggtgccgggcctgggggtccgggagggggccaggcccgaggcccagagccgggagagcctggccggaaagacctgcagcatctgagccgcgaggagcgccggcgccggcgccgcgccacagccaagtaccgcacggcccacgccacgcgagaacgcatccgcgtggaagccttcaacctggccttcgccgagctgcgcaagctgctgcctacgctgccccccgacaagaagctctccaagattgagattctgcgcctggccatctgctatatctcctacctgaaccacgtgctggacgtctgaactcagcctgtctcccacctcccgggcctctctggggcccctttccaccgctcactgcttagaaaggccgcatcctccccgagcccttataccttggcatggagtcccaaaggccctgggcacaggcagagagcccaccggctggtcatgagggcctcttcctttctctgacccaggcacctcgagggctattctcctgggttccttccggggtttattgctgaggcccagctgtgcagaattgtttgctagtgtggttggtatggaatccttgctggctttactaagccagccacacttggagtctgcccccaagctctctcactgaatgctgcctcttctacccctatgtccaaattttcagccaccacagacctcagctgtgtatcctatctgttctagcttctcctgcccctggtggggatgggctgtcagaattgcaagggaggaaggctggggttagagtggggagtgggcttcttcctccaagatctcagtctctcagtgcttggcagaggggtgaggccctggggaggcaggggttggtgccctgactcctgtgaggggaatctcagtagctgggaattatggaaaaactcttcctgtttctgtccatcttgttcctgtggcttagcacatacagacctcagatcttacttggtagtgagtgccttgccctctttgagctatttggctacttccctgtccctctgactcctactgtcccaattttctccctccctgtgtgtcactagagaaaaaaaaaaacaaaaacctagattccggattaggggatgacatcccaaacagcccggagtatttgcagaaggctcaggcaacgagtgggccacatctcacttctgcttcctcatctcagcccactctgaaaatgtgcagcaccctcactggttcctccccccaacgcaaggaggatgcccaattgttgccctctgaaaatgcacagttctcctggccctaggacttacttattacatttttttctctttccttgagctgcctttggcaagggaagagacccccaactctgcgcccctactccatgctgctgatccccacctgcgcactatagctcagggtcagcagtggaatgaagggccttagaacctgcatagaagaaatgaactcactgcatttctgtgctccctcctccctcgcaccaaactcctagctctacaagtatatttatttatttatttatttattcatctatttatttacttatttatttatttataaatattgctatttattgccgagttgtgcactttggggtagagtgaggggctcccagcagctctagctgggtctctcttgcttcctccctgcttacgcctttccttttcttgctccttcttcaactcctggtgtgtgtgagcatgccctttgcttgccacaccatatcctttccccagatccacctgtcctgacactctagtcctccaggatagtgctcctcccccagctccagggctcctggatgtccttcctcaactccctccacccctagacaatcctacctggtcccatctgcctcttttctctccccagcctgccctgtgacccttgcctcttcctgatactcccaagagcaggccccaggggtctgtgtcacatatctctgtgtgattccttctggttgcatccccaatttcatacaaaaagaaaaataaaagtgacctcgttctagcaccagg

SEQ ID NO: 158350 - DNA, 2512 bp, Homo sapiens
  Payload ID: 10999
  Gene Symbol: NHLH2
  Gene Name: nescient helix loop helix 2
  Uniprot ID: Q02577
  ENST ID: ENST00000320238
  CDS Start-End: 517-924
aattggtaccaggagagcccagaagccacacacgcatctctgcctctttgctctggctctcccaccctcttcccgtctttctctgcttccttgtcactgttactccaggagacgttcacttttcaccaacctttctccaagcatctccaagccactgactatatatattttgctacaagagacctagaagaggaaaaaaggcacgagacttttcaacacatcgtttaaaaaaatcatcaacgaatttcttgcaatgtttgagaacaattaaaaggaaaaagcgttttttaaaaaatctatcaactaagtgaacaatcattcatatcgtctacatcctgagatattattgtccctcgctgcggacaccagcgagatgacagctgctttttcatttttgaatgtaataaatatttgctgcttttaatattttccggaatctcccctcgctattccttggaattttaactctaaagattggagaacagattatcaaaaaggcttttgcaagcctccaaaatgatgctgagtccggaccaagcagcagattcggaccatcccagctcggcgcactcggatccggagtccctgggcggcacggacaccaaggtgctcggcagcgtgtcggacctggagccggtggaggaggccgagggcgacggcaagggcggcagccgagccgcgctctacccgcacccgcagcagctgagccgcgaggagaagcgccgccgccggcgcgccacggccaagtaccgctcggcccacgccacccgcgagcgcatccgcgtggaagccttcaacttggccttcgccgagctccgcaaattgctgcccacgctgcccccggacaagaagctctccaagatcgagatcctgcgcctggccatctgctacatctcctatctcaaccacgtcctggacgtgtagggcggggtgcgccgcggggggccgcctgtcccggcgtccgcgaaacgctacggatccggacgggcgccgtcgctcgggtggcggaggctgcggtggcccagcgagacggccgcctcgagagacggccggggaagaagctcgctacctgttctctctggtcagcagggcgacgagggaaggtttccgacgcaggcaggtggggttgtctggcgagcccgggggctcgcaggggggattttccaggccaggagaacctcgtggagacacccgagatgagccacttctggggctccccaagggttgtggttttaacccactggagactttgagttctcctacattcatccgccacaaatcttaatgtgttgaaagaatgagggcagaagttcagagtatgcaggctcataactttaggctatctggaatttttctaatggacaaatcaccaaacactgggaaggaggagagaggagggatctctcccatagagatggaaggcacagaaaggtgcgactggaaactttcctttctgttgtgaaaataaagattatattagaatccaaataaaccctgaatatttagtaagtttaaaaagacaaattgagaacaagtagacacactgtgggaggatctgagcttggtgatattttatccccaagatatgacaccaaggtagacaggaaaatccatatttaaatggaaactttaatatctgattacttttgcaggcgaagtgcccctttatatatccaaaaacatctatttgtgaccttaaacatgtggacccataggtgcagttagaaaaagacaacctatttttatttatgttagaaggagtagagtatttttttcaagacatttatttttcagagtggtgatacttttactttggatactctgtgccaatttatttatagtcaagtgtttacactttttcctgtggaataattatgtctaactttttacgtgtttgttgagattatactgtggtctttctttctgctctaattatattgcacttgtataacaaatttcccacttctccctgtttctaaacatattttatatattaagatgtttgttcttgaaaggttcttttgttgtgagatcagcaacactagcacttcactattatagttttttaaaaagtgtattattcttatctgtagttatgtctgagaagtcctttacaagctgtttataaggagagtagcttctttgtgtgtgtgatgtttgtgcgtgtgatgaatttagcaaattaagttattttcctaaaaaaaaaagaaaaaaagaattcagaactactttcctctgtgacaccaaaaagaaaagtctataacctgaaaatgtttcatgttctctgctgtgaaactcttaaaacaaggagtgtattttagagacaagggaaaaaaaccacatctgctatccaaagattttagtctttttcagggtttttttgtgtctctgttgctttatataatgcaatattttgtagtgaaaatagatataatctggtttctatctgacgagtttttcatatctcatgaatggtgcgctgttttgcatataaataaaggtatcaaataaa

SEQ ID NO: 158351 - DNA, 7226 bp, Homo sapiens
  Payload ID: 10999
  Gene Symbol: NHLH2
  Gene Name: nescient helix loop helix 2
  Uniprot ID: Q02577
  ENST ID: ENST00000369506
  CDS Start-End: 5546-5953
gagtatatctggatatgtttatttttctatgtcaatatatatctgttcctcaatatgtatttatactgaataataataataatgatagccaacacttactgaacatgagttctaggcattagtttaagcactttacatatattatcttgttcaccttcagaaaaaaacatgacataacattacataacatgctttgattattctcattttacagattagaaaactaaggtccaaaaaggttaagtaacttacaactaaattcacacagctagcatatgacagagccacaaagccggactttttaagtcactacttatcacctccccattcatttaataatattatttaatattactcttatagtctataatatcataatttgtatggtgcttactatttcatcaaatattttcaaatacattgggtctcatagcgagcctgtgaaatgagaagtgcaatattattattctcatttttacaggaaagaaaattgatagaactgaaccatgggtgtcctttagtggaagcgtttctatgttacaaatatctggggtacctctgtacatagagtcacatcataaatgaactgagtacctataatgtgtcaagctcagacattagtgctggggatataagctacagacctcccctggaagcatcatagcctaggaagagagaccagtgtggtaaccaagaaccaagaatcacggtacacaatatgtagtctctaagggagacatgaaaggagtgcttatggagcacagaaggaggggccatctgtgccagggaggtcttagaaaaggcaaaggggtgggggagggggaggctttgatggaagaaagaatgtgtgtgtgtgaatgtgaatccatgtctgtgtctatgacagtgtggctaggcatcactaagtatggatctgagtgtgtacctgtttatacaggcttacttctgtaagcattaatttttgtgtatgctggctgctggtatagaatgagtaagcctgaacataaaagggaatttgtctggtatcacacacaccatagcagaattggacctgccctgataggcacaccctgtcatgactccccaacaccaggggaaccagagatgctggtcctttcccactgtagcagctgcccactctagagctatggtgattagacccaccagtttttttcaatccatcagtatggatgtgtggtggtctaatagagccagccagcttgtatgatgaagggggaggaggtacaggtgtctgtgggtgtgcatctgtgtgcacacttctggttgtgtgtgaatgcttagcattggctgttcctaactagagtgagaaaacctcccttctcccttcattgtcaccaccttggggtgtttatccactcacccatttccattgccacctgtatgggaccggcttccatcttcactttaacgttctggggatatctaaaatatacctctgtgctggggttaggcagaagcaaggctggggagtgttggtgcccttatttgttggaggcactccctcctttccccgacccctgccccattgtggtccaggaatctctcaaaggagcaaaaatgtgggcaaaggcaaatagtacttgtggaagccatgaaaaacccggagggtcactcccaggggtgggctgctcaatgtgcctcccctggtgataaaatctgcttttagggcaaaattaaggaagacaagtgaggactcctctctccacaaatgttcccctaggaactggcggggtgggagtaaggctgtaatgctcttttatttctttaagcttgtatgatcaaaacaagctaaaataatcacaaataatatgttattgatattaactatgagtatcttcataaagtggcaaaataattgaactagattttattttttattataaggtatacaaattcagggccatgggatcatgtaaggcaaaggcattatgtactgggacacactggtaatttgtgtttacatcttggcacaagcactgccacgcagtacaatatattagcatgttaagatgggcaagaatgaagtgcaataatcaacacatgtagcatgtcatatttcagcttgaatgaatgagtgggtggagagaaaaacaaacatacagaaaagtagaattatctcatgtcgtggtccgtgaatatgtggattctctttctagttccaccaatggcttaatctattgaaaggttcttaccatctattgataagttagtctcatagcagatcatttctcaaaaatgttaatatgcttaatcaaaccttactgaagtatcttttaaaatgtaaatgatctctaataaatgttggctgttgcatgtctaaatactttattgcagcatcttatatagtatatatttccatgttctggacacaaatatttttctaaatattaagggaaagtggtggctttgtaatatgccaggggaattctttgatagtcaatatattgtttatttgtacttaaatatttcatcaataatctggaaaagagaaatagcctgactacggctagatactgtttagaggctaagatttctatcatgaactgcttttcaattgttatattttatggcacagattcagtgggaatctgatctgctaaaatatttgggctgtgaaaactcccacactgtgacagatgtcaagtccaattaagtgactcatgtccaggtttctgtccaataggatttcccattaaatatcaatttaggggaaaaaaattccatcccccttcctaagcctttatctcttccaccatctccaggctgaatcaattggtaccaggagagcccagaagccacacacgcatctctgcctctttgctctggctctcccaccctcttcccgtctttctctgcttccttgtcactgttactccaggagacgttcacttttcaccaacctttctccaagcatctccaagccactgactatatatattttgctacaaggtaaagagaagaggggctggggacgggggatatagccaaaccttgaaagactttgaaactggaaaataggtgtctatttatacaacatacaagtaagtgagggaagaggaagaggcaaccttagctcctagttacagtattgtgttcctgggaactggggagatatcagctgaacaaagccttatctcaaaaaaaaaaaaaaaatcacttctgagcaagatcacatctctgtcctgcacttcccagtttctgctcagccgtattaaggaaaagaaaggcatacgataggagcggaatcttatcttaaccatctttcttattgattattccgctattagaaagtggaggaatcagccctttgatgtgattgtgtttatctctgcatctcttttgttatttttagagacctagaagaggaaaaaaggcacgagacttttcaacacatcgtttaaaaaaatcatcaacgaatttcttgcaatgtttgagaacaattaaaaggaaaaagcgttttttaaaaaatctatcaactaagtgaacaatcattcatatcgtctacatcctgagatattattgtccctcgctgcggacaccagcgagatgacagctgctttttcatttttgaatgtaataaatatttgctgcttttaatattttccggaatctcccctcgctattccttggaattttaactctaaagattggagaacagattatcaaaaaggcttttgcaaggtaagactcctttaaataatttttttcagcttgaaataagttagattattcatactgtatctatagatgcagttcattccataaagagataaaacgcatacacggcatactatttatgaatatttttaaagatctagaggagaatttaatgtgctttgagggcaacccaggaactttttaccagaactacaactatttagtggcttattgtgattttccattactcgtctatttatttctgccctttcaagctgactgtgtaggtgcaagttgttctactcataaacgtacccgagaaaagcccgtagggagtcacatgcagctctctgggagcatttgtttttattttgccgtagaggacctgatttcctcgcagggaaattaaagctgttttggcccaattcgctcctctgcaagtgcggtgctgggaaccgatcacccatccccttgcttttgtttctctagaagcaaacgctcctatacgtcgccgacgcggatttctcccgtgccgagcgtcgtggaggctgcccacgccggggccccgagttctcagcctggtcctcactcccgacgcccaggggcggtgcgtgcagcccctgcaggggcctttctcctcctgccgggccctttctcgaagcccgaattacccggaagcccagcggttctgagcggccccctcccagaaggcgcacagtccgggccagtgctccaggcgccccagagaagcctggccaggtggcgtttccaagagggcacagttaagttagaggaaggctaagcaccgacatgcccggacttggccaggccacccggggacagctgcagcctgccgagctccggttccgggagcgcccgaactttgccggcagagatgcagctcccgccgggacaacacgcgctgcacccgctagtccccgcctgccccgccccgggcccttcccttctcttcccttccctctgcatcctctcctccctcagcggcccggctgccggcattttcccgcaaggtggtcgccagactgccgggcgcattgtctgatcccacgtcgccgtgtccctaggtcccctatgtgtgtggctgtctgcgtgacagatggtgctccgggagcctgcgagggcatcggagtcaattttctttttaaaggctcccccacgtttgtttagtcatttctttacgatttcggagaagcgcgaggggtccaagaagccttcccgcccccagccactggctctccgcctgcgctccaggatggggattcctgaccggccgcaccccagagccaggcgcccccggcgcagccccagaccagcgccaggccctcgggcgccgcggctgccgggttgcttcgccggaggccctcggggcgagaagtgcaccccgcgtctccccgcccccgtgaaaacccagatgtattcgttgttcgaaatcgctcgtttgtccgggaaggggacgaagggagggaggaggaatagcgcggttggcatttggccggaagaggcacaaaaacccagtcgcgaccccacaggcctgcggttgttccccaggcccagggccacaggcccgctgtggccgtctgcaagtcgaggtgtccagtctagtatgcggcctgggtcaaccgcgtccccgccggctcccgcgccagggcgaggcgcagggctcgcgccctcgggccagatcctatcggcgccctcccgcgtcgcgcgccggcctgctgtggggagggggcccgggccgcgcgtccgctgggaggaccggcgtggtaggcctcggcagccatccttccagcaaaataccctgattccttttactgattaattttccgacccctcctcagcctccaaaatgatgctgagtccggaccaagcagcagattcggaccatcccagctcggcgcactcggatccggagtccctgggcggcacggacaccaaggtgctcggcagcgtgtcggacctggagccggtggaggaggccgagggcgacggcaagggcggcagccgagccgcgctctacccgcacccgcagcagctgagccgcgaggagaagcgccgccgccggcgcgccacggccaagtaccgctcggcccacgccacccgcgagcgcatccgcgtggaagccttcaacttggccttcgccgagctccgcaaattgctgcccacgctgcccccggacaagaagctctccaagatcgagatcctgcgcctggccatctgctacatctcctatctcaaccacgtcctggacgtgtagggcggggtgcgccgcggggggccgcctgtcccggcgtccgcgaaacgctacggatccggacgggcgccgtcgctcgggtggcggaggctgcggtggcccagcgagacggccgcctcgagagacggccggggaagaagctcgctacctgttctctctggtcagcagggcgacgagggaaggtttccgacgcaggcaggtggggttgtctggcgagcccgggggctcgcaggggggattttccaggccaggagaacctcgtggagacacccgagatgagccacttctggggctccccaagggttgtggttttaacccactggagactttgagttctcctacattcatccgccacaaatcttaatgtgttgaaagaatgagggcagaagttcagagtatgcaggctcataactttaggctatctggaatttttctaatggacaaatcaccaaacactgggaaggaggagagaggagggatctctcccatagagatggaaggcacagaaaggtgcgactggaaactttcctttctgttgtgaaaataaagattatattagaatccaaataaaccctgaatatttagtaagtttaaaaagacaaattgagaacaagtagacacactgtgggaggatctgagcttggtgatattttatccccaagatatgacaccaaggtagacaggaaaatccatatttaaatggaaactttaatatctgattacttttgcaggcgaagtgcccctttatatatccaaaaacatctatttgtgaccttaaacatgtggacccataggtgcagttagaaaaagacaacctatttttatttatgttagaaggagtagagtatttttttcaagacatttatttttcagagtggtgatacttttactttggatactctgtgccaatttatttatagtcaagtgtttacactttttcctgtggaataattatgtctaactttttacgtgtttgttgagattatactgtggtctttctttctgctctaattatattgcacttgtataacaaatttcccacttctccctgtttctaaacatattttatatattaagatgtttgttcttgaaaggttcttttgttgtgagatcagcaacactagcacttcactattatagttttttaaaaagtgtattattcttatctgtagttatgtctgagaagtcctttacaagctgtttataaggagagtagcttctttgtgtgtgtgatgtttgtgcgtgtgatgaatttagcaaattaagttattttcct

SEQ ID NO: 158352 - DNA, 855 bp, Homo sapiens
  Payload ID: 10999
  Gene Symbol: NHLH2
  Gene Name: nescient helix loop helix 2
  ENST ID: ENST00000429731
  CDS Start-End: 535-855
acttctgagcaagatcacatctctgtcctgcacttcccagtttctgctcagccgtattaaggaaaagaaaggcatacgataggagcggaatcttatcttaaccatctttcttattgattattccgctattagaaagtggaggaatcagccctttgatgtgattgtgtttatctctgcatctcttttgttatttttagagacctagaagaggaaaaaaggcacgagacttttcaacacatcgtttaaaaaaatcatcaacgaatttcttgcaatgtttgagaacaattaaaaggaaaaagcgttttttaaaaaatctatcaactaagtgaacaatcattcatatcgtctacatcctgagatattattgtccctcgctgcggacaccagcgagatgacagctgctttttcatttttgaatgtaataaatatttgctgcttttaatattttccggaatctcccctcgctattccttggaattttaactctaaagattggagaacagattatcaaaaaggcttttgcaagcctccaaaatgatgctgagtccggaccaagcagcagattcggaccatcccagctcggcgcactcggatccggagtccctgggcggcacggacaccaaggtgctcggcagcgtgtcggacctggagccggtggaggaggccgagggcgacggcaagggcggcagccgagccgcgctctacccgcacccgcagcagctgagccgcgaggagaagcgccgccgccggcgcgccacggccaagtaccgctcggcccacgccacccgcgagcgcatccgcgtggaagccttcaacttggccttcgccgagctccgcaaattgctgcccacgctg

SEQ ID NO: 158353 - DNA, 5558 bp, Homo sapiens
  Payload ID: 11000
  Gene Symbol: NES
  Gene Name: nestin
  Uniprot ID: P48681
  ENST ID: ENST00000368223
  CDS Start-End: 134-4999
gctactcccaccccgccccgccccgtcattgtccccgtcggtctcttttctcttccgtcctaaaagctctgcgagccgctcccttctcccggtgccccgcgtctgtccatcctcagtgggtcagacgagcaggatggagggctgcatgggggaggagtcgtttcagatgtgggagctcaatcggcgcctggaggcctacctggcccgggtcaaggcgctggaggagcagaatgagctgctcagcgcggagctcggggggctccgggcacaatccgcggacacctcctggcgggcgcatgccgacgacgagctggcggccctgcgggccctcgttgaccaacgctggcgggagaagcacgcggccgaggtggcgcgcgacaacctggctgaagagctggagggcgtggcaggccgatgccagcagctgcggctggcccgggagcggacgacggaggaggtagcccgcaaccggcgcgccgtcgaggcagagaaatgcgcccgggcctggctgagtagccaggtggcagagctggagcgcgagctagaggctctacgcgtggcgcacgaggaggagcgcgtcggcctgaacgcgcaggctgcctgtgccccccgctgccccgcgccgccccgcgggcctcccgcgccggccccggaggtagaggagctggcaaggcgactgggcgaggcgtggcgcggggcagtgcgcggctaccaggagcgcgtggcacacatggagacgtcgctgggccaggcccgcgagcggctgggccgggcggtgcagggtgcccgcgagggccgcctggagctgcagcagctccaggctgagcgcggaggcctcctggagcgcagggcagcgttggaacagaggttggagggccgctggcaggagcggctgcgggctactgaaaagttccagctggctgtggaggccctggagcaggagaaacagggcctacagagccagatcgctcaggtcctggaaggtcggcagcagctggcgcacctcaagatgtccctcagcctggaggtggccacgtacaggaccctcctggaggctgagaactcccggctgcaaacacctggcggtggctccaagacttccctcagctttcaggaccccaagctggagctgcaattccctaggaccccagagggccggcgtcttggatctttgctcccagtcctgagcccaacttccctcccctcacccttgcctgctacccttgagacacctgtgccagcctttcttaagaaccaagaattcctccaggcccgtacccctaccttggccagcacccccatcccccccacacctcaggcaccctctcctgctgtagatgcagagatcagagcccaggatgctcctctctctctgctccagacacagggtgggaggaaacaggctccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcaggatggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcccggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctgggaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcccccaggaggaaggggaggagagcagagaagagagcgaggaggatgagctcggggagacccttccagactccactcccctgggcttctacctcaggtcccccacctcccccaggtgggaccccactggagagcagaggccaccccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggccctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaa

SEQ ID NO: 158354 - DNA, 3983 bp, Homo sapiens
  Payload ID: 11001
  Gene Symbol: NSF
  Gene Name: N-ethylmaleimide-sensitive factor
  Uniprot ID: P46459
  ENST ID: ENST00000398238
  CDS Start-End: 108-2342
ggcggttgcacgcctgcgcgagggcgggcggcgggggcgcgcgcgcggcgggggcgggctttgccgagcgcagagctgcagccgccgagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaagccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaa

SEQ ID NO: 158355 - DNA, 569 bp, Homo sapiens
  Payload ID: 11001
  Gene Symbol: NSF
  Gene Name: N-ethylmaleimide-sensitive factor
  ENST ID: ENST00000571172
  CDS Start-End: 86-569
agaaatgttaaagtgctgatggatttgcactagctgtatagatctttggtggaggaggaaatgggaaaattattaatttcagagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaagccatggatcctagcatcctgaagggagagcctgcgacag

SEQ ID NO: 158356 - DNA, 2667 bp, Homo sapiens
  Payload ID: 11001
  Gene Symbol: NSF
  Gene Name: N-ethylmaleimide-sensitive factor
  ENST ID: ENST00000575068
  CDS Start-End: 212-2431
agtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaagccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgc

SEQ ID NO: 158357 - DNA, 710 bp, Homo sapiens
  Payload ID: 11001
  Gene Symbol: NSF
  Gene Name: N-ethylmaleimide-sensitive factor
  ENST ID: ENST00000576346
  CDS Start-End: 303-710
gttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaag

SEQ ID NO: 158358 - DNA, 364 bp, Homo sapiens
  Payload ID: 11001
  Gene Symbol: NSF
  Gene Name: N-ethylmaleimide-sensitive factor
  ENST ID: ENST00000576040
  CDS Start-End: 231-364
atcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaagagcatgcaagcggcaagatgtcctacagatgaattatctttaaccaattgtgcagttgtgaatgaaaaggatttccagtctggccagcatgtgattgtgaggacctctcccaatcacaggtacacatttacactgaa

SEQ ID NO: 158359 - DNA, 548 bp, Homo sapiens
  Payload ID: 11001
  Gene Symbol: NSF
  Gene Name: N-ethylmaleimide-sensitive factor
  ENST ID: ENST00000571864
  CDS Start-End: 22-267
gagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaagccatggatcctagcatcctgaagggagagcctgcgacagggaaaaggcagaagattgaagtaggactggttgttggaaacagtcaagttgcatttgaaaaagcagaa

SEQ ID NO: 158360 - DNA, 580 bp, Homo sapiens
  Payload ID: 11001
  Gene Symbol: NSF
  Gene Name: N-ethylmaleimide-sensitive factor
  ENST ID: ENST00000465370
  CDS Start-End: 1-542
atgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagcgtccgagagaccaagcaaggaagttggttgtactgttggtttgctctccctgtcctgcttcgcaaaacttccttgtcacaatgcaggaaaaacttaatgtagcccccttgattttgattgaaaatgaactatttg

SEQ ID NO: 158361 - DNA, 3983 bp, Homo sapiens
  Payload ID: 11001
  Gene Symbol: NSF
  Gene Name: N-ethylmaleimide-sensitive factor
  Uniprot ID: P46459
  ENST ID: ENST00000611398
  CDS Start-End: 108-2342
ggcggttgcacgcctgcgcgagggcgggcggcgggggcgcgcgcgcggcgggggcgggctttgccgagcgcagagctgcagccgccgagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaagccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaagtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaa

SEQ ID NO: 158362 - DNA, 3983 bp, Homo sapiens; identical to SEQ ID NO: 158354
  Payload ID: 11001
  Gene Symbol: NSF
  Gene Name: N-ethylmaleimide-sensitive factor
  Uniprot ID: P46459
  ENST ID: ENST00000620290
  CDS Start-End: 108-2342

SEQ ID NO: 158363 - DNA, 2667 bp, Homo sapiens
  Payload ID: 11001
  Gene Symbol: NSF
  Gene Name: N-ethylmaleimide-sensitive factor
  ENST ID: ENST00000631254
  CDS Start-End: 212-2431
agtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacagcttgtctttagcttcaatgaaaagctttttggcttactggtgaaggacattgaagccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaagtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgc

SEQ ID NO: 158364 - DNA, 710 bp, Homo sapiens
  Payload ID: 11001
  Gene Symbol: NSF
  Gene Name: N-ethylmaleimide-sensitive factor
  ENST ID: ENST00000628506
  CDS Start-End: 303-710
gttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaagtctggataggaatcaag

SEQ ID NO: 158365 - DNA, 569 bp, Homo sapiens; identical to SEQ ID NO: 158355
  Payload ID: 11001
  Gene Symbol: NSF
  Gene Name: N-ethylmaleimide-sensitive factor
  ENST ID: ENST00000626883
  CDS Start-End: 86-569

SEQ ID NO: 158366 - DNA, 364 bp, Homo sapiens; identical to SEQ ID NO: 158358
  Payload ID: 11001
  Gene Symbol: NSF
  Gene Name: N-ethylmaleimide-sensitive factor
  ENST ID: ENST00000627873
  CDS Start-End: 231-364

SEQ ID NO: 158367 - DNA, 548 bp, Homo sapiens; identical to SEQ ID NO: 158359
  Payload ID: 11001
  Gene Symbol: NSF
  Gene Name: N-ethylmaleimide-sensitive factor
  ENST ID: ENST00000628895
  CDS Start-End: 22-267

SEQ ID NO: 158368 - DNA, 580 bp, Homo sapiens
  Payload ID: 11001
  Gene Symbol: NSF
  Gene Name: N-ethylmaleimide-sensitive factor
  ENST ID: ENST00000628495
  CDS Start-End: 1-542
atgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaagtctggataggaatcaagaagttactaatgctgatcgagatgtccctacagatggatcctgaataccgtgtgagaaaattcttggccctcttaagagaagaaggagcgtccgagagaccaagcaaggaagttggttgtactgttggtttgctctccctgtcctgcttcgcaaaacttccttgtcacaatgcaggaaaaacttaatgtagcccccttgattttgattgaaaatgaactatttg

SEQ ID NO: 158369 - DNA, 364 bp, Homo sapiens; identical to SEQ ID NO: 158358
  Payload ID: 11001
  Gene Symbol: NSF
  Gene Name: N-ethylmaleimide-sensitive factor
  ENST ID: ENST00000633653
  CDS Start-End: 231-364

SEQ ID NO: 158370 - DNA, 2667 bp, Homo sapiens; identical to SEQ ID NO: 158356
  Payload ID: 11001
  Gene Symbol: NSF
  Gene Name: N-ethylmaleimide-sensitive factor
  ENST ID: ENST00000632125
  CDS Start-End: 212-2431

SEQ ID NO: 158371 - DNA, 569 bp, Homo sapiens; identical to SEQ ID NO: 158355
  Payload ID: 11001
  Gene Symbol: NSF
  Gene Name: N-ethylmaleimide-sensitive factor
  ENST ID: ENST00000632852
  CDS Start-End: 86-569

SEQ ID NO: 158372 - DNA, 580 bp, Homo sapiens; identical to SEQ ID NO: 158360
  Payload ID: 11001
  Gene Symbol: NSF
  Gene Name: N-ethylmaleimide-sensitive factor
  ENST ID: ENST00000632862
  CDS Start-End: 1-542

SEQ ID NO: 158373 - DNA, 548 bp, Homo sapiens; identical to SEQ ID NO: 158359
  Payload ID: 11001
  Gene Symbol: NSF
  Gene Name: N-ethylmaleimide-sensitive factor
  ENST ID: ENST00000633834
  CDS Start-End: 22-267

SEQ ID NO: 158374 - DNA, 1839 bp, Homo sapiens
  Payload ID: 11002
  Gene Symbol: NAPA
  Gene Name: N-ethylmaleimide-sensitive factor attachment protein, alpha
  Uniprot ID: P54920
  ENST ID: ENST00000263354
  CDS Start-End: 301-1188
tggagcgccgttcgccggtatgtgcgcatgcgttgaggtctcttgacgccgattggggggtcacgagtcacgggcggcgtgcggcggctggtgggggcgtgtccggcggagcgggcgcggcgttacgaggccgctggttggccagcgctagtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttgcatga

SEQ ID NO: 158375 - DNA, 1417 bp, Homo sapiens
  Payload ID: 11002
  Gene Symbol: NAPA
  Gene Name: N-ethylmaleimide-sensitive factor attachment protein, alpha
  ENST ID: ENST00000594001
  CDS Start-End: 119-226
ccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgc

SEQ ID NO: 158376 - DNA, 989 bp, Homo sapiens
  Payload ID: 11002
  Gene Symbol: NAPA
  Gene Name: N-ethylmaleimide-sensitive factor attachment protein, alpha
  ENST ID: ENST00000601208
  CDS Start-End: 104-286
cgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttgggccccatccagaccctactgagcgaatcccaaagtgtgtggctgtgggactctggtttgatgaaatgagcacttcatgtggctgaaagggatgggcaggttggacacactgaatccgcagtgcagagggaaggaatgctcacatcccagctcccaaaattacctttgagcccctccacagctggggttggtgtggacaagttcccagaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaa

SEQ ID NO: 158377 - DNA, 379 bp, Homo sapiens
  Payload ID: 11002
  Gene Symbol: NAPA
  Gene Name: N-ethylmaleimide-sensitive factor attachment protein, alpha
  ENST ID: ENST00000598615
  CDS Start-End: 72-379
ggcgaattgcctggtgtggagaaacatccggggctgatggactggattgattagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttctt

SEQ ID NO: 158378 - DNA, 583 bp, Homo sapiens
  Payload ID: 11002
  Gene Symbol: NAPA
  Gene Name: N-ethylmaleimide-sensitive factor attachment protein, alpha
  ENST ID: ENST00000597274
  CDS Start-End: 152-376
agtcacgtggttcctggccgcaagcgacgcgcgccggtgcgacgtcaacgcagccgggcgagttttaccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacaggtagcccccttcctgcctgccccagccccgcaggga

SEQ ID NO: 158379 - DNA, 553 bp, Homo sapiens
  Payload ID: 11002
  Gene Symbol: NAPA
  Gene Name: N-ethylmaleimide-sensitive factor attachment protein, alpha
  ENST ID: ENST00000597118
  CDS Start-End: 143-553
ggataatgtttagcaaaataacttgaagaacatgatggcgaattgcctggtgtggagaaacatccggggctgatggactggattgattagaggctcatccaaaatagaggaagcatgcgaaatctacgccagagcagcaaacatgttcaaaatggccaaaaactggagtgctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacag

SEQ ID NO: 158380 - DNA, 416 bp, Homo sapiens
  Payload ID: 11002
  Gene Symbol: NAPA
  Gene Name: N-ethylmaleimide-sensitive factor attachment protein, alpha
  ENST ID: ENST00000594155
  CDS Start-End: 1-416
ctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaa

SEQ ID NO: 158381 - DNA, 1460 bp, Homo sapiens
  Payload ID: 11002
  Gene Symbol: NAPA
  Gene Name: N-ethylmaleimide-sensitive factor attachment protein, alpha
  ENST ID: ENST00000595227
  CDS Start-End: 81-851
tctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtgaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagaggtggggccgagacttgctggagagcttccctcctttcccatctggggagtgccgcgggccacagtgggcaggtggcaccgggggtcagcatgcaggggcgccagaggcccaggctgctggccggacagtcaccctctgttctcgctacatcccttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgtcccccagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgca

SEQ ID NO: 158382 - DNA, 554 bp, Homo sapiens
  Payload ID: 11002
  Gene Symbol: NAPA
  Gene Name: N-ethylmaleimide-sensitive factor attachment protein, alpha
  ENST ID: ENST00000594217
  CDS Start-End: 1-252
cacttctgcatcgacatgctcaacgccaagctggctgtccaaaagtatgaggagctgttcccagctttctctgattcccgggaatgcaagttgatgaaaaaattgctagaggcccacgaggagcagaatgtggacagctacaccgagtcggtgaaggaatacgactccatctcccggctggaccagtggctcaccaccatgctgctgcgcatcaagaagaccatccagggcgatgaggaggacctgcgctaagccccacccagccccccagtgcccgtcttcctgtcccatctgctcagagagagccaagctctaaagcacatgtagccgctgagacctgctgtttctgctgggggcaggctcctcttcccccagccccgggagcctcccccagcttcctgcagccccgacctctcaggttagaccctgggccctggagcttaggggattctccccaccccagccccacacctgctccttccctaatgctttgaggttttcttggttggaagctgcagctggcccaagaaagaaaataaaaaacaacacttttg

SEQ ID NO: 158383 - DNA, 891 bp, Homo sapiens
  Payload ID: 11002
  Gene Symbol: NAPA
  Gene Name: N-ethylmaleimide-sensitive factor attachment protein, alpha
  ENST ID: ENST00000593761
  CDS Start-End: 87-891
taccgatctgtgttccgcggcccggccgcggctgagtcttcccagggtcagggtcaggcgctttgctgagtccctttgtggccgccatggacaattccgggaaggaagcggaggcgatggcgctgttggccgaggcggagcgcaaagtgaagaactcgcagtccttcttctctggcctctttggaggctcatccaaaatagaggaagcatgcgaaatctacgccagagcagcaaacatgttcaaaatggccaaaaactggagtggtatgtcatctccgctagagctcctccaagctgctggaaacgcgttctgccaggctgcacagctgcacctgcagctccagagcaagcacgacgcagccacctgctttgtggacgctggcaacgcattcaagaaagccgacccccaagaggccattaactgtttgatgcgagcaatcgagatctacacagacatgggccgattcacgattgcggccaagcaccacatctccattgctgagatctatgagacagagttggtggacatcgagaaggccattgcccactacgagcagtctgcagactactacaaaggcgaggagtccaacagctcagccaacaagtgtctgctgaaggtggctggttacgctgcgctgctggagcagtatcagaaggccattgacatctacgaacaggtggggaccaatgccatggacagccccctcctcaagtacagcgccaaagactacttcttcaaggcggccctctgccacttctgcatcgacatgctcaacgccaagctggctgtccaaaagtatgaggagctgttcccagctttctctgattcccgggaatgcaagttgatgaaaaaattgctagaggcccacgaggagcagaatgtggacagct

SEQ ID NO: 158384 - DNA, 3837 bp, Homo sapiens
  Payload ID: 11003
  Gene Symbol: NAPB
  Gene Name: N-ethylmaleimide-sensitive factor attachment protein, beta
  Uniprot ID: Q9H115
  ENST ID: ENST00000377026
  CDS Start-End: 87-983
gtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaattttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttctttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgatcctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaa

SEQ ID NO: 158385 - DNA, 3824 bp, Homo sapiens
  Payload ID: 11003
  Gene Symbol: NAPB
  Gene Name: N-ethylmaleimide-sensitive factor attachment protein, beta
  Uniprot ID: Q9H115
  ENST ID: ENST00000398425
  CDS Start-End: 353-967
gaaaggcctcgcgcgtcgcgcctgcgcctgcgtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgctgcaggaaacgcattttgtcaggcagccaagctccacatgcagcttcagagcaaacatgactctgctaccagctttgtggatgctggaaatgcttacaaaaaggcagatccccaagggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaattttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttctttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgatcctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaagta

SEQ ID NO: 158386 - DNA, 3754 bp, Homo sapiens
  Payload ID: 11003
  Gene Symbol: NAPB
  Gene Name: N-ethylmaleimide-sensitive factor attachment protein, beta
  Uniprot ID: Q9H115
  ENST ID: ENST00000432543
  CDS Start-End: 118-897
gaaaggcctcgcgcgtcgcgcctgcgcctgcgtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaattttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttctttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgatcctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaagta

SEQ ID NO: 158387 - DNA, 3883 bp, Homo sapiens
  Payload ID: 11003
  Gene Symbol: NAPB
  Gene Name: N-ethylmaleimide-sensitive factor attachment protein, beta
  ENST ID: ENST00000617876
  CDS Start-End: 118-1026
gaaaggcctcgcgcgtcgcgcctgcgcctgcgtccctgcggccgccagagggagggttaaggcgcctgggcgcacagcgagccggctgagggggctgtggcggccgcggcgggcgacatggacaacgcggggaaggagcgtgaggcagtacagctgatggcggaggccgagaagcgagtcaaggcctcccactccttcctccgagggctgtttggaggaaacacaagaatagaagaggcttgtgaaatgtataccagagctgcaaatatgttcaagatggctaaaaattggagtgtgtcttcttcagctgcaggaaacgcattttgtcaggcagccaagctccacatgcagcttcagagcaaacatgactctgctaccagctttgtggatgctggaaatgcttacaaaaaggcagatccccaagaggctatcaactgcttaaatgcagccatcgacatttacacagacatgggaaggtttacaattgcagccaagcaccacattactattgcagagatctatgagactgaacttgtagacattgagaaggctattgcacattatgaacaatctgctgattattacaaaggagaagaatccaacagctcagcaaacaagtgtctgctgaaggtggcagcatatgctgcccagcttgagcagtaccagaaagccattgagatctatgagcaggttggggcaaacacaatggataatcctttgttgaaatacagtgcaaaggattacttcttcaaagctgccctctgccacttcatagtagacgagttgaatgccaagcttgctcttgagaaatatgaggaaatgtttccagcatttactgattcaagagaatgtaaattattgaaaaaactcctagaagctcatgaagaacagaacagtgaagcttacactgaagcagtgaaggaatttgactcaatatctcgcttggatcagtggctgaccaccatgttgcttcgcatcaaaaagtccatccaaggggatggagaaggagatggagacctaaaatgaaatgtttttgtctttgtggcatgcagctaactcctctttagttttgtcttagggtcaagtgatctttatgggatgcctatttaatggcttaattttgttgcatatgagccagacggcctgtgtattgtttaagctcgccaagtctgtgttgctgtgaaatgaatgaaggagaggctcctgttcatcttgtggtaatgatgggttgtttcatgcttatcagaacccccagcgttttctgagaagtacttcagaatctcattcctcatatttcattggtatttgtggagcctatgtttaatgttgccacgtgtttttatgtcctttttgttggacttgagtactcagcccagttgttctcatagatgctttgcattttctctgtgctttggcatctgaatatgttctttaaatgtgtgtttagtttaggacagttactaggaatgagtttataacttcattagaaatcatttctatttttgttatcctgtgattattttgatggtgctagtgactagtttctttgctttttgtgttgttccgtatgctaacatgtgcatggcaaaaatttagaatagccagggtctgtaggcatcacattgtgaggaagggagctttctggaagtacttgcttcatgtatggatgagtgtcaaagtgaatttgatttgtacttagacacacgcgtttacacacacacacatatcacaagatctgttagaaatggaatttttctctttttctggagatagttttcacttttagttggagtggaaatccctttatatttacattgaagtattttaattggcatagcctgctcattattttcatgtttatacactttcccacgttgaggtggtgtgttctgtgctgtgactatagaaatcttggtcagggctggatagattatctaagtcaagcttgagaatgaatgtatgtaattttcctgtttattgtacatgatgggttaggtggggtgaatgtggtacaggaatgtcctgtatgcccaagtgggcaagaaccccaacttgtttctcaggggacttgattgttctcttagctggtggaatatgttggcttatgtgtttgaactctgtcgtgtttaattggtttatataatatatgtatgctatcttgattcatgaacttgatcctattaatttatatgctgatattgtactttagacatacgcttgtctcctgaatgtcctctgaatatttatagttaaatgatttatatttgaaatgtgttgccagacttaacccagcagacactctgacatcacggagcttcactgatgacaggtaacgaaacttcctatgttatgtcaggtagtagtaagtagtattggaatgatgttttcatttttggtggctctcaactggaattggtagtgtttccaggccaagggtcgactgcaggttgtttgagaaatgatgagtaggtcagtctaggaagaaagagaaagtagcaggaaaggaagtgggaagggccagccaaggacagactgtagaggatccacatcaggtggccacgaggacttgcaggctatagttatggtggtgacatgcatgaggtgggctggtagagcaggaagctctgtgatgtcagagcatctactgggactacaggtgcactgtagtccccactactgggggtggcaatgaagacactctgtctgttgggccctagaatttaatgtggatttcctccttccttccaagttctgagattcttaaatgagagctggctgtcttctagaggtaagacctggaatggagtccagttggtactttttcactccctcttagaatctcttatgaaaaaatgatcagagagaaaagtggggttttgtttccccacctaataatatatcctacaaccagccaaatgcacttttgtgaaaatggggtgtgaggagtggttctgcagcttgagtcctctggttttaagtagtttgtttctacttgtttaaagaatcttctggtctgaccacttaaagtaaaaactacatgatttattttcgggcaattatgtttagctttcatcattatactccaacagacccgtctgaaggggtatttttttttaacaataatgtttgtaacattttgttgtgtcaattagagggtcacttgtttgtattgcaataaacactgggaccagttccggggttaagaattaatttttgtttttaatatttcacatgaaaagaatcaaagtaattgtaatggctagaagagacctgccagaagattaaaaaaaagaatgagagaaaagcccagttagtggtgtgcaaacttacttcctttaaatgtcccatggatgtaggacagtgccatgtttcaagatgcctgtgagctaggtcttcaagatttatagaatgttacttatgaacaaaatataattatttatggtacaattcttgtactttagcaaatctggagttagttcatagtcaaagtcagttaatatttcttagaggaaagttttgctttttgtggcaacatttttatagcttgtgtgagttcttttttatttaatgatttgaaagcagtatttttgcacagtcgtgaccgtgtgtggtggcgtcactgtaaccaaagtatatgcaccagcccttgtgcatttattgtttctcctgattttgtggatttaaatgtccaaatgcaaacctttgtgacttcctttggaggacttggcagcacagcatgcccccgtgacctgcctgctgtggtatgagctatgaccaagagcaggcttcctgctccatggagtcctgagttgctctggggcaggggattacgttatgaaaactaaccatgtgtaacaataaatctaccttagcagaaaaagta

SEQ ID NO: 158388 - DNA, 3548 bp, Homo sapiens
  Payload ID: 11004
  Gene Symbol: NAPG
  Gene Name: N-ethylmaleimide-sensitive factor attachment protein, gamma
  Uniprot ID: Q99747
  ENST ID: ENST00000322897
  CDS Start-End: 70-1008
ggcggattcttggcgccggaggaagaggcagggtcaccctctctccacgtcagagacctgactgtggagatggcggctcagaagataaacgaggggctggaacacctcgccaaagcagagaaatacctgaaaactggttttttaaaatggaagccagattatgacagtgccgcttctgaatatggaaaagcagctgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctcttatatattatgagtttgaaaaattttgaaggtagcatattgaagtgatctataaatatcttcagtcctctctgaagtgtgggtatttcttctatctaaaaaatacatacagtgactgtcttcaaatctacttggttcttgaccaaataggagctaatgggtaatgaatacctttttgtttgtttgtttgtttgttttgttttttgtttttttttttaagggtctcactcttttgcccaggctggagtgcagtggcacaatcacggctcccaggctaatgtttttatttttaatttgtaattttttttttattttttttgttgagatggagttgctccatgttgcacaggctgttctcaaactcctaagctcaagccatctgcctgccttggcctcccaaagtgctgggattgtagacataagccacctcacccagcctatgaatatctttctaacattgtaagaatgaggtaatgtttccatcagtctaatacagatatatttcttccctccaaaacagtttattttgattgtttattttattttgattgtaactccgtcataacttgacatggaaaatgctatatactatgaaaacttagctgaaagggaagaattgttttagaaagacaatatttaaaacaccgcactgccaatatattgatcctttatagttatttcctaaaatgctgttttcgaaacattcctttttcaccctgttgtgtggcttagacccatctcgtaatctgttaattggaaagaggctacagacaccagcagtgtgcgttctgcaggtacacgctgccaaagtaattcctgctcatccatgccctgtctctgtctcttttagagtcataccttatttgagtataggttgcttaattttgctagacttcctgaaaacactaaggtggagtatcagaagtgattttagtcacagttctgcgggagagcttagaataacatcctcctttgggaggtggtctcgggtgcgtggatgttggtatacagtctttattgtaagtctgatacaaaatgctaataaatttaatgtttttcttccttaatttattggcatagttcttcaggtagcacctcatttttattaatgatattgggattaactatgaacaagctatatgtagacatttgcatttaaggacattgcagtgtttcaaagatcccatcattgcagcttgtatcctttagatccaatcggaaacttctggagtcttacattaatgctcatttgagctaattagtaatctgtttaaacagatttggcaatactttaaagatactgtagactatttatgtatagatagatcatattacccattaaagtctgggggaaaaaattttttaattttactcttcttatgtactgaaaactttttttaaaaaaggtgatgatgaagtgcattctgtagcagcagcgcagctatgctttaaaccacacaaaaggctgtgtccaggtgcagcctccttcacccttcctgcccacggtgaggattgaataaccaggacttggggatattgtttgttgtcagggttattctgtgtggtaaggaatatttgtttcacatttatacattttctttttccactcacgtaagtttctatcttgagagcatagtccaaagtgcaaaacttggtgtttacaaggaaaattgtcttccagaactccactgtcatcactttcaccaaagtggaagtttgcatgaatatgctcagaatctaatattcaatgttctgttacattgtaagtgaagtccagctacaaaatagatttaatatattgaatttatttgtacatatgcagagtacggtatttctgtatggaatctgctttattcctatttttcccaactctgatgagtagaatattaaatgtgttgttatggaaatacagattattgcttctataggaagataattatgaaaataaaacctgaaactata

SEQ ID NO: 158389 - DNA, 694 bp, Homo sapiens
  Payload ID: 11004
  Gene Symbol: NAPG
  Gene Name: N-ethylmaleimide-sensitive factor attachment protein, gamma
  ENST ID: ENST00000582472
  CDS Start-End: 164-694
ggactcggcgcagtgctgcggggcgagggcttctctacttgggcgctctgctcctgaagattgtggtgggggctgtctgtgcatcggaggctcgttagcagcatccttggcctctacctgctgggtgccggtcgcatctcttccccatttgtggcaacccaaaatgtcatctggggaacaacatcgctctgttgagaaccaccgccctagaagagccccctgtgtggaggggaccataggtttaccccaaaaactcctcggtgaacctttgtcatctggcattttactgtccctgtgggcagggactgtgcttcgttcgtcctttgatgtgtatgtcctgccacctctggtacacctgaaaactggttttttaaaatggaagccagattatgacagtgccgcttctgaatatggaaaagcagctgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaag

SEQ ID NO: 158390 - DNA, 1245 bp, Homo sapiens
  Payload ID: 11004
  Gene Symbol: NAPG
  Gene Name: N-ethylmaleimide-sensitive factor attachment protein, gamma
  ENST ID: ENST00000580224
  CDS Start-End: 75-143
atttgggcggattcttggcgccggaggaagaggcagggtcaccctctctccacgtcagagacctgactgtggagatggcggctcagaagataaacgaggggctggaacacctcgccaaagcagagaaatactgttgcttttaaaaatgccaaacagtttgagcaagcaaaagatgcctgcctgagggaagctgttgcccatgaaaataatagggctctttttcatgctgccaaagcttatgagcaagctggaatgatgttgaaggagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattat

SEQ ID NO: 158391 - DNA, 1516 bp, Homo sapiens
  Payload ID: 11004
  Gene Symbol: NAPG
  Gene Name: N-ethylmaleimide-sensitive factor attachment protein, gamma
  ENST ID: ENST00000580483
  CDS Start-End: 199-255
ctctttgcggggcgcaccggcaggctcccagccccgcttcgtcgcagcggcttgggccctccggccctccgtagccgctcgactgtcgcgctgcaccagcttcctcctcggcgttcccacgcctatttgggcggattcttggcgccggaggaagaggcagggtcaccctctctccacgtcagagacctgactgtggagatggcggctcagaagataaacgaggggctggaacacctcgccaaagcagagaaatagagatgcagaaactaccagaggccgttcagctaattgagaaggccagcatgatgtatctagaaaacggcaccccagacacagcagccatggctttggagcgagctggaaagcttatagaaaatgttgatccagagaaggctgtacagttatatcaacagacagctaatgtgtttgaaaatgaagaacgcttacgacaggcagttgaattactaggaaaagcctccagactactagtacgaggacgtaggtttgatgaggcggcactctctattcagaaagaaaaaaatatttataaggaaattgagaattatccaacttgttataagaaaacaattgctcaagtcttagttcatctacacagaaatgactatgtagctgcagaaagatgtgtccgggagagctatagcatccctgggttcaatggcagtgaagactgtgctgccctggaacagcttcttgaaggttatgaccagcaagaccaagatcaggtgtcagatgtctgcaactcaccgcttttcaagtacatggacaatgattatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagagatgagatggggacaggaagttattttgagccttacaatattatttagcccaataaaagatgcattgaagctctta

SEQ ID NO: 158392 - DNA, 5954 bp, Homo sapiens
  Payload ID: 11005
  Gene Symbol: NTN1
  Gene Name: netrin 1
  Uniprot ID: O95631
  ENST ID: ENST00000173229
  CDS Start-End: 108-1922
cttcgggggcgagcgcgcgtgtgtgtgagtgcgcgccggccagcgcgccttctgcggcaggcggacagatcctcggcgcggcagggccggggcaagctggacgcagcatgatgcgcgcagtgtgggaggcgctggcggcgctggcggcggtggcgtgcctggtgggcgcggtgcgcggcgggcccgggctcagcatgttcgcgggccaggcggcgcagcccgatccctgctcggacgagaacggccacccgcgccgctgcatcccggactttgtcaatgcggccttcggcaaggacgtgcgcgtgtccagcacctgcggccggcccccggcgcgctactgcgtggtgagcgagcgcggcgaggagcggctgcgctcgtgccacctctgcaacgcgtccgaccccaagaaggcgcacccgcccgccttcctcaccgacctcaacaacccgcacaacctgacgtgctggcagtccgagaactacctgcagttcccgcacaacgtcacgctcacactgtccctcggcaagaagttcgaagtgacctacgtgagcctgcagttctgctcgccgcggcccgagtccatggccatctacaagtccatggactacgggcgcacgtgggtgcccttccagttctactccacgcagtgccgcaagatgtacaaccggccgcaccgcgcgcccatcaccaagcagaacgagcaggaggccgtgtgcaccgactcgcacaccgacatgcgcccgctctcgggcggcctcatcgccttcagcacgctggacgggcggccctcggcgcacgacttcgacaactcgcccgtgctgcaggactgggtcacggccacagacatccgcgtggccttcagccgcctgcacacgttcggcgacgagaacgaggacgactcggagctggcgcgcgactcgtacttctacgcggtgtccgacctgcaggtgggcggccggtgcaagtgcaacggccacgcggcccgctgcgtgcgcgaccgcgacgacagcctggtgtgcgactgcaggcacaacacggccggcccggagtgcgaccgctgcaagcccttccactacgaccggccctggcagcgcgccacagcccgcgaagccaacgagtgcgtggcctgtaactgcaacctgcatgcccggcgctgccgcttcaacatggagctctacaagctttcggggcgcaagagcggaggtgtctgcctcaactgtcgccacaacaccgccggccgccactgccattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagactgcgattcctactgcaaggcctccaaggggaagctgaagattaacatgaaaaagtactgcaagaaggactatgccgtccagatccacatcctgaaggcggacaaggcgggggactggtggaagttcacggtgaacatcatctccgtgtataagcagggcacgagccgcatccgccgcggtgaccagagcctgtggatccgctcgcgggacatcgcctgcaagtgtcccaaaatcaagcccctcaagaagtacctgctgctgggcaacgcggaggactctccggaccagagcggcatcgtggccgataaaagcagcctggtgatccagtggcgggacacgtgggcgcggcggctgcgcaagttccagcagcgtgagaagaagggcaagtgcaagaaggcctagcgccgaggcagcgggcgggcgggcgggcgggcgccagggcggggccgagcgagagcgggcgccttggcccggccgccgcggacttggcccgcgagggctttcccaggtggggggagggagggggcggggccgcacggcgcggggggcgggaccctcggcggcccctccccctacccccaccctgcgcgctctgggcgggagccgcgtgcacgcggggcggggtgcgccgccggccgggccctggagaaatgacgagacgtagctacctcacggggctccttccagagcagagacgcgcttccctgggcctgggcgcggccgccgtggaggggctgggggcagcctgccctggggcccgggggcgggcgcagaatcgcacaactggggccccaggcgcggggcgtggatggcgcggagacgtggacgggaggagaactgtgaattctcaagcccgtagtgtgggcggggcgcggagcacccaccaaaccaccacccgacacgcagccgacgggatccccccctttctccccggccccttctagcagttccccgcgggccacctggctgtcacagcctggactcctccatctgaaggggcctggcagcatttggggagtggacagctcctgtccagccagcatgccccaggcggcctctgtctccactgctacctgctgagtgggtcctactgggtgggggcttggggtcggtgagtggttcacctgtggagagaggagaggaagcccctgctgctgcctgtctctgcccctgcccctgcccctgcccagcgtggggctggcccatccggaaggcagtgggcccagggacacccctgagaagcccaagccgggtggtcaccgcctcatgctggagctgcctgttggaggaggcatcgcaaacgcaaaacctcccagagagtttccttttggaaacttggaaccagccctttttatgacgttttccagggggagggggaggggcactggctgggtttacggcagtgacactatttatgtaaatgacatcagctcccgcaaggcccctcagcaatgtcaacagctggaaagggcctgaacgggcttggagtctgcaggctgcgaaggcacttgggcctggcttggggccgggggcttgtttgagctgggatggggtttgctggctcagtgaagtaccagagtgcctgagccatgggtgggcaggggcacaggaatgaccaggttcctgggggccaaggaggccatgctggcttctccaagggaaggcacagaggctgccggcctgccccctacagctgtcttgggtctggcctgggccacaccttgaccgtgcctttccagacggtctttgtggagtctgcccgtgccctccactgtgccccagccctccttccaaaatctcctagagacacggtcctcaagcaggcagccccttttgttctgacctcctcacacagggtccattcctgtgccctggggcctcctggctccctgccttcctgggctctctgcactgcccgggcctctggcccacatcctcacacccggcgcactgaattaagaggcctggctcccctcacagtcaggaaattggtttcactttcccggccagagtttggctgctcaaaagggtcataccaagtatgaagctcggcccccggtggtctggcttccctccgccttccccacatttacccgcatcacggctgccatttattgagcacctgctgtgtgccaggcactttacccacatgctcccagtgtgtactcatgacaaccctgtgggacagggactcattatcaccagcaaggagactggagtacacgtgcccaaggtcatgctgcaaattggtggcaggactggggctcaaactccagagcccgactttctgaccaggggccacgctggccctcactgcactccagctctgcagcctacccgcccaatccctgtgcaggctgggagggtgctcttgggggagtggccaccgagcccctggccctggttactgcctcttgaggacactggcatctgggctggagaacaggagcccggggtggggtagggcatggggacaatcacatcttcagaggaggcagcaaagtggtgcgggatgcagggacggacttgccagatggcagctccaggttccaggaaggcaggccttggatgctccgaagaggtggtagaaaggtgtttttagaaaggtgttttggctgcctcagggtggttggagagactccaggagagactggcagaggtgcctcaggggcagggagcagacagacctgccctgggaaggggcatttggcttccctgaatccagcccaaggctagaagacagggcccctctccaagctgtcagcgcccctcggatgcccagtgtggtgtgctgggcgccatcagcatcacaaggcactacgctgctggggcggttgtcctatttctgtctatgccagtgtggtttcttcaccctgcccagaagggctgtggcagccccacgatatcccaccctgggtctgggtctcacgggtgtcctgtgaggggcttgcatttgtggtggtctctgaggccacctcagcaacggagctggcgacacgccaagcaacaaggcatcttgcggaaaattcagccagtgtcctgcccctcccttcggctcagcaccccgcagggcacaggctgtccgcccggtggtctggcccttggggaatgcgtcagggtgaccagatccaccatgctagcagccaggtcactgttgggattgcacggtcgtcacgagctgcctttcctatccacacacccagccaggacccagcccaccactcccgactgcagccccggcctctgcggtgagcaccatccttgggaaagcacccctcctccactccggtgccccactccaaggagcagagggaaatgggaattgaggtgtcccggtttgtacagttaggaagggatgtaaaacggaactagattttgattttgaagagtgtattaaccagaattgtgctatgtaggtgtttgtttgaagaaaaacataccagattagtctttgtttttgaaacagcttccccagttgtcctttttcttaccagctgggtggtctggtgcccctgacagctgagtgcctgctttacggacacgcagtaatgccgaagatttgcgggggaggacatagggctgtccccgggattcacctgctggctgtggtctctgcccactgcttctgtccttggaaagcagggcaggaggcagcatccccaggggcctctatgtgggagggagggacacctggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcctgccttcaggaaagtgaaagacgcttaggctgtcaacacttaaaggaagtccccttgaagcccagagtggacagactagacccattgatggggccactggccatggtccgtggacaagacattcctgtgggccatggcacaccgggggggatcaaaatgtgtacttgtggggtctcgccccttgccaaaagccaaaccagtcccactcctgtcattggacgtttcttcccattccctcctcccaaatgcacttcccctcctccctctgccccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaatgtgggccccacatgatagaactaaattcagatatcattaaataaactcttgtacacta

SEQ ID NO: 158393 - DNA, 700 bp, Homo sapiens
  Payload ID: 11005
  Gene Symbol: NTN1
  Gene Name: netrin 1
  ENST ID: ENST00000436734
  CDS Start-End: 1-462
cattactgcaaggagggctactaccgcgacatgggcaagcccatcacccaccggaaggcctgcaaagcctgtgattgccaccctgtgggtgctgctggcaaaacctgcaaccaaaccaccggccagtgtccctgcaaggacggcgtgacgggtatcacctgcaaccgctgcgccaaaggctaccagcagagccgctctcccatcgccccctgcataaagatccctgtagcgccgccgacgactgcagccagcagcgtggaggagcctgaagctgcccgccagcccaacaccttccaggctgaggggttgtcactccttcctggggctgcagagaaggaaggagccagatgctggggatacagaaggaggcttgggcacagggtcgcacaagcagaatgcagggggcccaggagctgggcgtgggggagaatcacatcttcattttcattcgcctctaactaaaaatttagcatttcctccatggcaaagagaggccgcagaccgcagcatgcggccaagcctgcaccgtggtcactggcggaagtcacagcggtttacacatcacattctagctggtgcagatatcataaatatcgttcatgctggttattgcttctcaaaacgacagaagttactagacctgctgctagatcctgatttataatcattaataaagaagcactcgcgtaacgtaaccata

SEQ ID NO: 158394 - DNA, 1986 bp, Homo sapiens
  Payload ID: 11006
  Gene Symbol: NTN3
  Gene Name: netrin 3
  Uniprot ID: O00634
  ENST ID: ENST00000293973
  CDS Start-End: 204-1946
gaggacgcgccaacatccccgctgctgtgctgggcccggggcgtgcccgccgctgctcccacctctgggccgggctggggccgcccgggggccctgttcctcggcattgcgggcctggtgggcagagccgcggagagggcttcttttccccaagggcagcgtcttggggcccggccactggctgacccgcagcggctccggccatgcctggctggccctgggggctgctgctgacggcaggcacgctcttcgccgccctgagtcctgggccgccggcgcccgccgacccctgccacgatgaggggggtgcgccccgcggctgcgtgccaggactggtgaacgccgccctgggccgcgaggtgctggcttccagcacgtgcgggcggccggccactcgggcctgcgacgcctccgacccgcgacgggcacactcccccgccctccttacttccccagggggcacggccagccctctgtgctggcgctcggagtccctgcctcgggcgcccctcaacgtgactctcacggtgcccctgggcaaggcttttgagctggtcttcgtgagcctgcgcttctgctcagctcccccagcctccgtggccctgctcaagtctcaggaccatggccgcagctgggccccgctgggcttcttctcctcccactgtgacctggactatggccgtctgcctgcccctgccaatggcccagctggcccagggcctgaggccctgtgcttccccgcacccctggcccagcctgatggcagcggccttctggccttcagcatgcaggacagcagccccccaggcctggacctggacagcagcccagtgctccaagactgggtgaccgccaccgacgtccgtgtagtgctcacaaggcctagcacggcaggtgaccccagggacatggaggccgtcgtcccttactcctacgcagccaccgacctccaggtgggcgggcgctgcaagtgcaatggacatgcctcacggtgcctgctggacacacagggccacctgatctgcgactgtcggcatggcaccgagggccctgactgcggccgctgcaagcccttctactgcgacaggccatggcagcgggccactgcccgggaatcccacgcctgcctcgcttgctcctgcaacggccatgcccgccgctgccgcttcaacatggagctgtaccgactgtccggccgccgcagcgggggtgtctgtctcaactgccggcacaacaccgccggccgccactgccactactgccgggagggcttctatcgagaccctggccgtgccctgagtgaccgtcgggcttgcagggcctgcgactgtcacccggttggtgctgctggcaagacctgcaaccagaccacaggccagtgtccctgcaaggatggcgtcactggcctcacctgcaaccgctgcgcgcctggcttccagcaaagccgctccccagtggcgccctgtgttaagacccctatccctggacccactgaggacagcagccctgtgcagccccaggactgtgactcgcactgcaaacctgcccgtggcagctaccgcatcagcctaaagaagttctgcaagaaggactatgcggtgcaggtggcggtgggtgcgcgcggcgaggcgcgcggcgcgtggacacgcttcccggtggcggtgctcgccgtgttccggagcggagaggagcgcgcgcggcgcgggagtagcgcgctgtgggtgcccgccggggatgcggcctgcggctgcccgcgcctgctccccggccgccgctacctcctgctggggggcgggcctggagccgcggctgggggcgcggggggccgggggcccgggctcatcgccgcccgcggaagcctcgtgctaccctggagggacgcgtggacgcggcgcctgcggaggctgcagcgacgcgaacggcgggggcgctgcagcgccgcctgagcccgccggctgggcagggcggccgctgctcccacatcta

SEQ ID NO: 158395 - DNA, 3152 bp, Homo sapiens
  Payload ID: 11007
  Gene Symbol: NTN4
  Gene Name: netrin 4
  Uniprot ID: Q9HB63
  ENST ID: ENST00000344911
  CDS Start-End: 98-1873
ggagaaggacgggacggagccggggcagccagaagaggtgggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctga

SEQ ID NO: 158396 - DNA, 3615 bp, Homo sapiens
  Payload ID: 11007
  Gene Symbol: NTN4
  Gene Name: netrin 4
  Uniprot ID: Q9HB63
  ENST ID: ENST00000343702
  CDS Start-End: 450-2336
ggacgggacggagccggggcagccagaagaggtgggaaaagcggaggaggacgcccaggaggaggcggcggcggcggccgggaagtgaaaggtctcgcaaagttcagcggcggctgcgggcgccgagccccgggctagcggcagacgagcccgcagggccgctccgcggggcagcgcagccaggccggctatggtcccggggctcccgccgccccccaggtgcccgggacccgccaggccggtgcgcgagggtcaccccacctccccgcgcggtcccggcccctggctcccagctgccggcgaccgctgaccgagcccggcgccccaggaggaggaagaaaccagggccccgttccctcccgaggacggcggcgcttcatcccgcagcccagaggtctcggctccctccggcacccgcccggcccggctgctcccggctcctcccggccatggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctga

SEQ ID NO: 158397 - DNA, 1971 bp, Homo sapiens
  Payload ID: 11007
  Gene Symbol: NTN4
  Gene Name: netrin 4
  Uniprot ID: Q9HB63
  ENST ID: ENST00000538383
  CDS Start-End: 98-1873
ctagagggagtctactgctcttaggaatgttccgggagaaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtg

SEQ ID NO: 158398 - DNA, 1818 bp, Homo sapiens
  Payload ID: 11007
  Gene Symbol: NTN4
  Gene Name: netrin 4
  Uniprot ID: Q9HB63
  ENST ID: ENST00000553059
  CDS Start-End: 1-1818
atggggagctgcgcgcggctgctgctgctctggggctgcacggtggtggccgcaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcagtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtag

SEQ ID NO: 158399 - DNA, 749 bp, Homo sapiens
  Payload ID: 11007
  Gene Symbol: NTN4
  Gene Name: netrin 4
  ENST ID: ENST00000547980
  CDS Start-End: 220-749
gagggaacaaaggacccagctcgccatcccccggcacttcatggcctaaggaatgatgaggaggggtggcccagcgaccctgggcgcgcgtgggctggggccggtctctggtagaagcccatcgctggtgtccctgacctggtgctgggtactagagaaccaggactgagtggagtagctggagtgagttcccgctgtgaaaaagcctgcaaccctcggatgggaaatttggctttggggcgaaaactctgggcagacaccacctgcggtcagaatgctaccgaactgtactgcttctacagtgagaacacggatctgacttgtcggcagcccaaatgtgacaagtgcaatgctgcctatcctcacctggctcacctgccatctgccatggcagactcatccttccggtttcctcgcacatggtggcagtctgcggaggatgtgcacagagaaaagatccagttagacctggaagctgaattctacttcactcacctaattgtgatgttcaagtcccccaggccggctgccatggtgctggaccgctcccaggactttgggaaaacatggaagccttataagtactttgcgactaactgctccgctacatttggcctggaagatgatgttgtcaagaagggcgctatttgtacttctaaatactccagtccttttccatgcactggaggagaggttattttcaaagctttgtcaccaccatacgatacagagaacccttacagtgccaa

SEQ ID NO: 158400 - DNA, 1836 bp, Homo sapiens
  Payload ID: 11008
  Gene Symbol: NTN5
  Gene Name: netrin 5
  Uniprot ID: Q8WTR8
  ENST ID: ENST00000270235
  CDS Start-End: 97-1566
gagagcccaccgcgccacagcttggaggaagagcctgcggggaactggctgcaggacgctctcttcttgagtgcaggtgctggctctgctgtgaccatgcccgtgacctttgccctcctgctcctcctgggccaggccactgcggacccatgctacgatccacagggccgcccccaattctgcctcccgccagtgacacagctggctgccgtggcggcctcctgccctcaggcctgtgccctgtccccaggaaaccaccttggcgccagggaaacctgcaatggcagcctgactttggccctgggtggccccttcctcctgacatctgtcagcttgcgcttctgtaccccaggacccccagccctcatcctgtctgctgcctgggcctcagggggtccctggaggctgctgtggcacaggcccgcctggcctggggccttagggggccctgaaagggtgaccttccactccacaccaggtcctaaggccactgtggcggccagccacctccgtgtggagtttgggggccaggccgggctagcggcagctgggctgagaggccgctgccagtgtcatggccacgctgcccgctgtgccgcccgtgcccggcccccccgctgccactgccgccaccataccactggcccggggtgcgagagctgccgcccgtcccatcgagactggccctggcggcctgccacgccccggcacccccacccttgcctaccctgctcctgcaaccagcacgcccgacgctgccggttcaactctgagctgttcagactgtcgggcggccggagtgggggtgtttgtgagcggtgccgccaccacacagctgggcggcactgccactactgccaacctgggttctggagggaccctagccagcctatcttcagccgcagggcctgcagagcctgccagtgccaccctattggggcaacaggaggaacctgcaaccagaccagtgggcagtgcacctgcaagttaggggtcacaggcctgacctgcaaccgctgtggccctggctaccagcagagccgctcccccaggatgccctgccagcgaattccagaggcaacaaccacccttgccactactcctggtgcttatagctctgaccctcagtgtcaaaactactgcaatatgtcggacaccagggtacacatgagccttcggaggtactgccagcaggaccatgttctccgcgcgcaggtgctagcgtccgaggcggcgggcccggcatggcagcggctggccgtgcgcgtgctggccgtttacaagcagcgggcgcagcccgtgcgacgcggcgaccaggacgcctgggtgccccgcgccgacctgacctgcggctgcctgcgcctgcagccaggcaccgactacctgctgctgggcagcgccgtgggcgaccccgaccccacgcgcctcatcctcgaccgccacggcctcgcgctgccatggaggccgcgctgggcccggcccctgaagcggctgcagcaggaggagcgcgccggaggctgccgcggcgtgcgggcacccacacccagtcccaggccggagcactagacgtgagatggggctgcctcgagcaccaacaaagtaatttgggagcgactaggagctgagccttctacctcgacggtgcactgcagagagccaatcagacgtcgcagagccccgacgacactatgcttgcgcccacgccgagcaggcgtgcggaacttttagcaaaaggcggcaagcgggacttctggtcccaacatttcctcctttggcctgtggcttattccccgccagtgatctgtttcccccaataaagtctcaaatctttgggaa

SEQ ID NO: 158401 - DNA, 701 bp, Homo sapiens
  Payload ID: 11008
  Gene Symbol: NTN5
  Gene Name: netrin 5
  ENST ID: ENST00000596844
  CDS Start-End: 477-701
tctgctctgagcccccgcccagcccagaaaccccactagcctggggcctgagaacagccacgccactccctcctgagagcccaccgcgccacagcttggaggaagagcctgcggggaactggctgcaggacgctctcttcttgagtgcagcctgctcctgcaaccagcacgcccgacgctgccggttcaactctgagctgttcagactgtcgggcggccggagtgggggtgtttgtgagcggtgccgccaccacacagctgggcggcactgccactactgccaacctgggttctggagggaccctagccagcctatcttcagccgcagggcctgcagagcctgccagtgccaccctattggggcaacaggaggaacctgcaaccagaccagtgggcagtgcacctgcaagttaggggtcacaggcctgacctgcaaccgctgtggccctggctaccagcagagccgctcccccaggatgccctgccagcgaattccagaggcaacaaccacccttgccactactcctggtgcttatagctctgaccctcagtgtcaaaactactgcaatatgtcggacaccagggtacacatgagccttcggaggtactgccagcaggaccatgttctccgcgcgcaggtgctagcgtccgaggcggcgggcccggcatggcagcggctggccgtgcgcgtgctggccgtt

SEQ ID NO: 158402 - DNA, 1485 bp, Homo sapiens
  Payload ID: 11009
  Gene Symbol: NTNG1
  Gene Name: netrin G1
  Uniprot ID: Q9Y2I2
  ENST ID: ENST00000370065
  CDS Start-End: 1-1485
atgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaattgtgaatgcttcggccactccaatcgatgcagttatatcgatctgctaaatacagtcatttgcgtgagctgtaaacacaacactagagggcagcactgtgagttatgcaggctgggctacttcagaaatgcttctgcacaactggacgatgagaatgtgtgcatagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctag

SEQ ID NO: 158403 - DNA, 1443 bp, Homo sapiens
  Payload ID: 11009
  Gene Symbol: NTNG1
  Gene Name: netrin G1
  Uniprot ID: Q9Y2I2
  ENST ID: ENST00000370066
  CDS Start-End: 1-1443
atgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaatcctccaaagtttaataggatatggccgaatatttcttcccttgaggtttctaacccaaaacaagttgctcccaaattagctttgtcaacagtttcttctgttcaagttgcaaaccacaagagagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctag

SEQ ID NO: 158404 - DNA, 4628 bp, Homo sapiens
  Payload ID: 11009
  Gene Symbol: NTNG1
  Gene Name: netrin G1
  Uniprot ID: Q9Y2I2
  ENST ID: ENST00000370067
  CDS Start-End: 628-2010
gcatttcggaagaggacgtcaacgggaaggaattccccctctgggtgcgggctccgagagggggcgacttgcaggaggctccccccgggggcggaggcgaagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaatcctccaaagtttaataggatatggccgaatatttcttcccttgaggtttctaacccaaaacaagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaacgatttcaggaatttgtattgcaatttcttaagatgaaaggaacagccaccaagcagtttcacactcactttactgatttctgtgtggactgagtacattcagctgacgaatttagttcccaggaagatggattgatgttcactagcttggacaacttctgcaaaatatgagactatttccacttgggaaaaattacaacagcaaaaaaaaaaaaaaaaaaaaaaaaaaatctaagtgattgccaagattatgccaaagcctgttggcagagtactaagagacttttatttttaagtcatgctattttcacagattgatggtgatcatgtgactctagggatgctgatctatgtatctttccaaatacagtgtttacatggagtatcacaagacgcaacctggggaaccaggaagggagcagggaaattgagtgatttgcaatttgactttgaatatattcagacttaagtatttagaggaaatatcaaaatataaagcagcaagtagacataactgctgttcctgagaataaagtttgttttaagtgctgcccaaggtgtaataaattcttgtttctgccttttattaggccaattactgtgcaagacagcaaggggaggcaggtggggaagaacctttgcaaagtttcaaagaggctaagacagtgtgcatttcgttcccagcacactgttgtcctacagattacaagtgtattagcagcagcatctcctggaatcaaaaacaattatcagcccgaaccagagtcttaaggacaatgaaattctacatgacttggtagaacaataacctatgatagtgtaaggtcagaaacctagttccagtctgaattcttcaccctgctgccactccttgctgaaacagggaaggggggaggaatgtctcctgataaataacctgggtaaaaactagatgaaggaacagcatgtcttattggttttgttcccagaaaagccaattcgaagaaggcaataaaaggtaaacaggtaatgcctgtgctgcctgccaccccacgtctaagtctattgaatgtttgttattcaaaccaacagtctcttttgatgtaagaaataaggaaagatggaaataaattagagcttaggcttagtgccagagtggccaaccagaaattggagatttacgttggaagcataaatagaaaattatatttcaggctcaccaaagaaacacatgaaaatgctgataacatagggagtttgagattatttataatgaggtggatttctgatattaaaattagagtttaagttgtcttatagtttattagcacaaaccaaaggcagcccatgttatttctggcaaagatgcactttatcgttatctgctcatggctttgtcgcaacgctcaggaatcagacactgcacacttcaatagttgggattccaaaagctaattctaaaatttaatgaaggcctgatttaaactgattcatctgcattttatctttatgaggccataagaatctaaattgatgaggaatatctttcattccgtgtatttagatatagttttctgaatttcctgaagcgatgtgatctgcttttaataaaaattcacttttaggt

SEQ ID NO: 158405 - DNA, 4034 bp, Homo sapiens
  Payload ID: 11009
  Gene Symbol: NTNG1
  Gene Name: netrin G1
  Uniprot ID: Q9Y2I2
  ENST ID: ENST00000370068
  CDS Start-End: 847-2466
taaaagtttaaggcgagaagtgtcagaggcagcggagcgaggaggcgcggaggagagccggcgagcaggggactgggctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaattgtgaatgcttcggccactccaatcgatgcagttatatcgatctgctaaatacagtcatttgcgtgagctgtaaacacaacactagagggcagcactgtgagttatgcaggctgggctacttcagaaatgcttctgcacaactggacgatgagaatgtgtgcatagagtgttattgtaaccctttgggctcaatccatgatcgttgtaatggctcaggattttgtgagtgtaagactggaacaacagggcctaagtgtgatgagtgtctgccgggaaattcctggcactacggctgtcaaccgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaacgatttcaggaatttgtattgcaatttcttaagatgaaaggaacagccaccaagcagtttcacactcactttactgatttctgtgtggactgagtacattcagctgacgaatttagttcccaggaagatggattgatgttcactagcttggacaacttctgcaaaatatgagactatttccacttgggaaaaattacaacagcaaaaaaaaaaaaaaaaaaaaaaaaaaatctaagtgattgccaagattatgccaaagcctgttggcagagtactaagagacttttatttttaagtcatgctattttcacagattgatggtgatcatgtgactctagggatgctgatctatgtatctttccaaatacagtgtttacatggagtatcacaagacgcaacctggggaaccaggaagggagcagggaaattgagtgatttgcaatttgactttgaatatattcagacttaagtatttagaggaaatatcaaaatataaagcagcaagtagacataactgctgttcctgagaataaagtttgttttaagtgctgcccaa

SEQ ID NO: 158406 - DNA, 3149 bp, Homo sapiens
  Payload ID: 11009
  Gene Symbol: NTNG1
  Gene Name: netrin G1
  Uniprot ID: Q9Y2I2
  ENST ID: ENST00000370071
  CDS Start-End: 719-2161
gaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaatcctccaaagtttaataggatatggccgaatatttcttcccttgaggtttctaacccaaaacaagttgctcccaaattagctttgtcaacagtttcttctgttcaagttgcaaaccacaagagagcgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagattt

SEQ ID NO: 158407 - DNA, 3347 bp, Homo sapiens
  Payload ID: 11009
  Gene Symbol: NTNG1
  Gene Name: netrin G1
  Uniprot ID: Q9Y2I2
  ENST ID: ENST00000370073
  CDS Start-End: 719-2338
gaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtaattgtgaatgcttcggccactccaatcgatgcagttatatcgatctgctaaatacagtcatttgcgtgagctgtaaacacaacactagagggcagcactgtgagttatgcaggctgggctacttcagaaatgcttctgcacaactggacgatgagaatgtgtgcatagagtgttattgtaaccctttgggctcaatccatgatcgttgtaatggctcaggattttgtgagtgtaagactggaacaacagggcctaagtgtgatgagtgtctgccgggaaattcctggcactacggctgtcaaccgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcat

SEQ ID NO: 158408 - DNA, 3048 bp, Homo sapiens
  Payload ID: 11009
  Gene Symbol: NTNG1
  Gene Name: netrin G1
  Uniprot ID: Q9Y2I2
  ENST ID: ENST00000370074
  CDS Start-End: 719-2035
gaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtacgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaac

SEQ ID NO: 158409 - DNA, 3984 bp, Homo sapiens
  Payload ID: 11010
  Gene Symbol: NTNG2
  Gene Name: netrin G2
  Uniprot ID: Q96CW9
  ENST ID: ENST00000372179
  CDS Start-End: 335-1603
cgcagcccggatcagaccgagagataaaagccccgatggtgatcacaagtcagaccccaggtacctggatggattgagagctgagatctcagcaactttctgatctgtccatcagcagtctgagaaacgctggctctgaattttccgtgtcggccttttggaaacaacaagttcctcgctgtttgcaaagcttcagtgctcgggtccctgggacaccccggccaccctcgcctggtagatgtggcatttccatgctgaggccgcgagtcccgcctgaccccgtcgctgcctctccagggcttctctgggccgcgcctctgcagactgcgcagccatgctgcatctgctggcgctcttcctgcactgcctccctctggcctctggggactatgacatctgcaaatcctgggtgaccacagatgagggccccacctgggagttctacgcctgccagcccaaggtgatgcgcctgaaggactacgtcaaggtgaaggtggagccctcaggcatcacatgtggagacccccctgagaggttctgctcccatgagaatccctacctatgcagcaacgagtgtgacgcctccaacccggacctggcccacccgcccaggctcatgttcgacaaggaggaggagggcctggccacctactggcagagcatcacctggagccgctaccccagcccgctggaagccaacatcaccctttcgtggaacaagaccgtggagctgaccgacgacgtggtgatgaccttcgagtacggccggcccacggtcatggtcctggagaagtccctggacaacgggcgcacctggcagccctaccagttctacgccgaggactgcatggaggccttcggtatgtccgcccgccgggcccgcgacatgtcatcctccagcgcgcaccgcgtgctctgcaccgaggagtactcgcgctgggcaggctccaagaaggagaagcacgtgcgcttcgaggtgcgggaccgcttcgccatctttgccggccccgacctgcgcaacatggacaacctctacacgcggctggagagcgccaagggcctcaaggagttcttcaccctcaccgacctgcgcatgcggctgctgcgcccggcgctgggcggcacctatgtgcagcgggagaacctctacaagtacttctacgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtgccactgcaggttcctttggcaccttgcaaacccctccccctgggaggtcgccatctgctctgcgaggcagcaggagaggactggccaatgtcaaagagccagccgggagcagaccccaaatctcagagatgcttctggggtgcaccgtcaccctccaccagggctctgtggggccccacatcccacccaagttgtccctcccggacccagggggcccctggctgggaagccagtgagccgagagggcgccagaaagaagctggaccctgcagggacgctggtctgcacagccgtcgtaagttgcttctctgtggtgtccccaccccggcaaccccccaaccctctcttgcttttcccatctctcaccaggcatcagcaggtcccagaaagaccccgaccccaaaggccctgtggccactgcggccaccacagccatgacaggggcccctactactcctgtcccctccacgtccactgcctgggcccccatggcgcccagcaccccacagcccacaggtgggtgccagggtacagcgacccctgtcatcccaccctctcctgcttctagcctgggtccctgcctctcttggggtgggagggtcggcagccctgggcagagagcaggggcttggctcttagaatagagacgctagaaccctagagctgggaggccacaggccaaaggggcttgaggacacctgggtcaacctgttcctgagcccagccaggggattcagggatcagttcagcttccaaagtcgtcttcctcctgcccttcaagccattgcttggaagggctcccagaccattgtggccagacggctgcaggaactgagaggaaaggtgctgggggcagcgaggccatcctgacatgcagccaaagactggccttatctcccaatggtgcttctgcctccgtggtccctggagccccgcccacaccctgtccccacctggcccccagggcctctctgtccttagcccctcagcagcacaccggtgggatggatggagcagggttagcccagaaagcaaatgtctctgatcagcagggcaaagggagcctctggagctgagtttggacaccgtgggctgctgggaatgtggaggctgtgtgtgtagtgcaaggccaggccagggccagacgtcctgccccctcaggggtctgccacagacaggcatggaaacctgattctcgctcccctccaacggagggattcacgtgtattcaaggctgggggtgctggagtgggcctctgctctcacctggactcacctggggagtatccctgcactctgtgcagtgcaggtgccaggggtctgaaaggatttatccttcccagagggcaccaggaagacgatgaccaaggggaattcttcctggtcccagccagggaggggtgctccaatagcctgccacaccctgtcccccgccaccctgcagggaggacctggtggggactcctggccccttgggtagtgccctggccctccatctctctgatccaaggagacctgccccactgatccttcccccttggggggtggcatttctaaagggcagagtcccctccatcagctcctgcctcggcctgttgctgggtggacactcaggctccccagacaggggcaaatgctgagagaaagacctcctccttcctaggccatccagagcagctcccctgggggcagcacaccccacctctttctacatccttccttttctgcaggaggcatttacaggaggcaggggctagccaaaagattggaggatttccgggaagcctcctgacccaggaatcctctttggggtggaagacatgggtcactctgagaattctggacttcagacataggttggcccagccacaagggacctgtgctttgctgctgagcctgtggtgggcagacagaagcaaaaacagtggtggtgggtgctgtgcctgtctccaaacaggggtttggctgggaggccagatactctccatatcacatgtgcaagtgcacacatgcacacacacacatgcatgcacacacacaggcatgcacacgcacatgtacacacacacacacacagaggaatccatttgcagagctgcttctgacttggtgccagggcagccgtgggaggctgggcagattgtgcaaagttgggaattaaagaggaaaagtcagaggccagagtgggaaatgcaggggaggtgagggtccccaggaccccctcagtgagcagaaggcacaccctccctctcggcaagacagtgctgctctgcaccctcagccctgtatcaagaagcaggacattaggggaggaggtggctccaatgtgacagccagtggcccctacagcccacatctaggggctcctccctcctcttcagcaactgaagcccctgtccagagcccccattaatgaaaacgatcattgcagtagctgagggtgagttctcctgggctgtgctcgtatcattgtatcatcatatcattgtattctgggctcacagctccgtgagatggaggctgttattttcctagtcccacaggtgaggggatcgaggcttaggaagaagcagctggattttatgatatgtaaattacacctcaatcaagctgtttc

SEQ ID NO: 158410 - DNA, 4792 bp, Homo sapiens
  Payload ID: 11010
  Gene Symbol: NTNG2
  Gene Name: netrin G2
  Uniprot ID: Q96CW9
  ENST ID: ENST00000393229
  CDS Start-End: 777-2369
cgctcagcccgggcgggcgatgcgggcggcgcgggcggccccctcccccggcccgcgtctccgggacggctgcgggcggcccccccggcggccggagggctccctggccccgatctgacggcggcggcggcggcggccacagcggcgggagcggcgcggggaaggagcagcggctcgcagccctcggcccgcgcccccacccagcgccagcccgaggggggaggcgcagcgccggagggtggcggtcctcggccctcccaggtctccgcgccgggaagccgctccgagccggggctggagggttgttttgccgttgtgttgagcacgtcacccattaagagccctttaaagacctggattgattggaaggacaaaaattaaaagcaatctgatccagcctcatgcaggatccctgcggattttctccttatcccatttccatccactgtcacaatttgagaatctgcctgatttgatcagattcacctccaggggaggtgtgataccagggttaggaggacgtgaagttatgggcaactttctgatctgtccatcagcagtctgagaaacgctggctctgaattttccgtgtcggccttttggaaacaacaagttcctcgctgtttgcaaagcttcagtgctcgggtccctgggacaccccggccaccctcgcctggtagatgtggcatttccatgctgaggccgcgagtcccgcctgaccccgtcgctgcctctccagggcttctctgggccgcgcctctgcagactgcgcagccatgctgcatctgctggcgctcttcctgcactgcctccctctggcctctggggactatgacatctgcaaatcctgggtgaccacagatgagggccccacctgggagttctacgcctgccagcccaaggtgatgcgcctgaaggactacgtcaaggtgaaggtggagccctcaggcatcacatgtggagacccccctgagaggttctgctcccatgagaatccctacctatgcagcaacgagtgtgacgcctccaacccggacctggcccacccgcccaggctcatgttcgacaaggaggaggagggcctggccacctactggcagagcatcacctggagccgctaccccagcccgctggaagccaacatcaccctttcgtggaacaagaccgtggagctgaccgacgacgtggtgatgaccttcgagtacggccggcccacggtcatggtcctggagaagtccctggacaacgggcgcacctggcagccctaccagttctacgccgaggactgcatggaggccttcggtatgtccgcccgccgggcccgcgacatgtcatcctccagcgcgcaccgcgtgctctgcaccgaggagtactcgcgctgggcaggctccaagaaggagaagcacgtgcgcttcgaggtgcgggaccgcttcgccatctttgccggccccgacctgcgcaacatggacaacctctacacgcggctggagagcgccaagggcctcaaggagttcttcaccctcaccgacctgcgcatgcggctgctgcgcccggcgctgggcggcacctatgtgcagcgggagaacctctacaagtacttctacgccatctccaacatcgaggtcatcggcaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtgccactgcaggttcctttggcaactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattgagtgtaactgcaaccagataggctccgtgcacgaccggtgcaacgagaccggcttctgcgagtgccgcgagggcgcggcgggccccaagtgcgacgactgcctccccacgcactactggcgccagggctgctaccccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgcctccacggcctgttttctttctgtgttggggacggtgggcaggtgtggggcttacagaggaatccacaacacagccttaaagaaacggtttccctactggggccaccatttccctgggcctttctgtggattccagcaggcagtgccccctccccgcaggcttggctggcagagttttccaccccgcggccaggctgcaggtgccccacctgttaggagcctccccacactgaaaggctgcctccctcctttcccaaaaaagaaatccggagtgtattggcccttttctacagaagtccaagggaaatgactcagggagaatcctagcagaggttgaatccaatgctctgatttatactgtgtctcggtggccacctccgatggatgtgtcatctcagacctgttgcagccggagcctcaagtccaatatcagatgaagctgaacccacaattcggccaccgcctccttccagagtttcagatggccaggtgggcagaggcgggcagtgcagagaccccagacgtgccggccctgtcctccctaccttctcaagattaggaaggggtgctggaggggacaggggcagcttgggagtggtgaggaagctcctagattcggggctcatcccctggggcctctgattcagaggatccagcagttctcccatctccgcttggtgtctccagccctggggccacacttccccctcggtccagcctcctgtccacctatgtttatttcagagcagtgccgggggtccggtcctggttgctaactgctgccactgctccacctgcaggtgctcccagcactggcttctgccaccacacctgttctttcccagctgcgaggtttagacctgggtccttcccttgagtccccaaagctaagctaagaccaagtggaacaaacttggccttggggacagcaggagattacaacacagaaaaggagggggaggcacaacgggacactgcataggactcacagtgtcccgagcccacacaccagcccctcctggcctcctctctctgctcccacccccagcaccctgctgacccggaagtgccttccgacaggccctgcatcctcctgcagctggcccatctctaccctcacattcttccttacgcacagaaccccactgcctgggacccaaagtgcccagataaaataaaacacctctctggggcttcttgtggataggagtggccaggggacacagctctgggcagtgagatgtaagcaggactgatgggtgggcttccagaaagttcttaaaagtcatcccttcctccacgccccacaaagcctcagttgtccaagtttgtggctctggtttttctctctcatccctccctctgctcttcagtcagcaggatggggaaggagccttcttgagacactgagcataacagtgtcaccctcaggatagtgaagggtggagccgggggtggaagttgcagagcctgggacacctgccttggctgcaacctctgcactgcttttatttatctacttatttttatagagttgaggtctcactatgttgcccaggctggtctcaaactcctaggctcaagtgagcctccggccttggcctcccgaagtgctgagattacaggcatgagccaccgcaccacctgcctgtcttactgtgtgagaaaaaaaataaacggtgatgtgattaaaacactagaa

SEQ ID NO: 158411 - DNA, 949 bp, Homo sapiens
  Payload ID: 11011
  Gene Symbol: NENF
  Gene Name: neudesin neurotrophic factor
  Uniprot ID: Q9UMX5
  ENST ID: ENST00000366988
  CDS Start-End: 58-576
gggcgtgctagggccccgccgccctggcccggccttgccttgcgctgcgcgctcaccatggtgggccccgcgccgcggcggcggctgcggccgctggcagcgctggccctggtcctggcgctggccccggggctgcccacagcccgggccgggcagacaccgcgccctgccgagcgggggcccccagtgcggcttttcaccgaggaggagctggcccgctatggcggggaggaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctgatgttccccctgcaggagcaggttcttgggagcgtgaggcaggaagacactaggtgctgaatctcctgcaaaactggctgcctggaggccctgagccacccagatctgaataaaacagatgcttaccctggaagagcaaatgcctcctgttgtccttggtcaggggttctgtctacctggggacccctgtctgcacaccagggatcaataagagccaaagtgggacacctcctagatgtcagtatcagctggctgggcagtggaattttgagcgacctttactttatacttttctgtgcttgacagattttcagccatgaccatgttcactttataatcaaaacaaaaataaaggtcccatttttacaaaagga

SEQ ID NO: 158412 - DNA, 7237 bp, Homo sapiens
  Payload ID: 11012
  Gene Symbol: NGRN
  Gene Name: neugrin, neurite outgrowth associated
  Uniprot ID: Q9NPE2
  ENST ID: ENST00000379095
  CDS Start-End: 9-884
gcgtcgacatggcggttaccctgagtctcttgctgggcgggcgcgtttgcgccgccgtcactcgctgtgggttcgcgacccggggggtggcgggcccaggccctattggccgggagccggaccccgattccgactgggagccggaggaacgggagctgcaggaggtggagagcaccctgaaacgacagaaacaagcaatccgattccagaaaattcggaggcaaatggaggcgcctggtgccccgcccaggaccctgacgtgggaagccatggagcagatacggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctgcctctttggtgctctttggggtgggatggtttacctgtgaaccttggagagagggaaggacaaaggcagaaaggaaggatccctggtcagtaaacattgggagagagatggaaccagaggaatttcccagcaaagggctctgtgcagagcatcctgcttagtgagggattctgacaactgaaaactggacgcctttcttttagttgctggggttctggcagagattgggaaatgaggggttggcagaaaatacaaagcaggcaaaggctttagggcccttataatctccagccacattttaaagtttatattaagagctgggcatggcagaatgtgcctacagtcccagttacttgggaggccgaggtgggagaatcgcttgagcctcggaggttgaggctgcagtgagctatgattgcaccactgcactccagcctgggataacagtgagacccccatctctaaataaaatcaatcgatcttcaattatgtctcattatacagtttacttaaccagatttttacaatggtgccatggtgtaggcaatcccggattaagaggtcccttttacaaataaggaaatagactttaagatggctgccagtaagtggcagtgctgggacttaactcgggtctcatcattaatccagggcttctggaattccgggaatatggcactgtctgccataattttgttaatttactgcttgttttagaaatacatctgttataactagaaattcggggacagcttagtcaatttgttttccttacaagcaaaataaagtaaaatgtagcagtctgctcattagtgctctggtgggatggtttacctgtgaaccttggagaaccatgtcctgctttcacaatttaccaggaaaaatggctactccgaatttaaatatatgtaggacattaatggaaacacctacattccaactcagtcattgccactctgtagaatcttactgctatttcaaatgtccaattacagcaattaaaatactgattactgttgcttttatcaattattattgataacttgaggatctgttctcagtataaatgacaaagccctgtcacatgccaagcaaaattctacgatccagatgctggtaatacaacagtgggcagataggacctttgctgtcactgccctgtcactatcatgtagttcatagtagaagcttatcagtatttttatggttttgttatatttatggtatttaattgttaaagatgtgttagatgctgtttgattgtttaaatttgcatttctcactcctgcaaatatctgatcatgccatacccttttcgcagtgggctatagaaacctaaaggctgttcttaaaactttgttttttaatttatttttgacacggactctcgctctgtcgcccaggctggagtacagtggcacaatctcagctcactgcaacctccgcctcccaggttcaactgattctcctgcttcaacctcccgagtagctgggattacaggcgtctgccactgtgcccagctaatttttgtgtttttagtagagatggggtttcaccatgttggccaggctggtctcaaactctgacctcaagtgatctgcctgtctcggcctcctacagtgctaggattacaggtgtgagccaccacgcctggcctttatttttcttttgagacagggtctcactcttgtcgtccacactggagtacagtggctcaatcttgcctcactgcaacctctgcctcccaggttcaagcggttctcattcttcagcctcccgagtagctggaactacaggcgggcaccaccatgcccagctaattttttttatatttttagtagagacaggatttcaccatgttggccaagctggtctcaaactcctgacctcaagttatctacctgccttggcctcccaaagtgctgggattataggcgtgagccaacacgcctgacctttatttcttttgagacagggtcttgctctgtcatccatgctggagtgcagtggctcaatctcagctcactgcaatctctgcctcctgggttcaaactattctcattccttagcctcccgagtagctgggactacaggcatgcaccaccacacccagctaatcttttatttttagtagagataggatttcactatcttggccaggctggtctcgaactcctgtgctcaggtgatctgcctgcttcggcctcccaaaatgctgagattacaacgtgagccaccacgtgaggcaggcggatcacctgaggtcaggagtttcagaccagcctggccaacatggcaaaaccccatctctactaaaaatacaaaaattatctgggtgtggtggcagatgcctgtaatcccagctactgggaaggctgaggcaggagaattgcttgaacccgggaggcagaggttgcagtgagccgagattgtgccactgcacttcaccttgggtgacagtgagactccatctcaaacaaacaaacacctccaatgctgtatctcaaataccatgtctacccttcttcctgctttacttcatctattacacaagtaatacatactcattaaagaaaaagacaagcaaaatgaaaacaaaagtcatccctgatcccaccagtgaagagttactatcctaccaacatttttctaagcatatgtacaactttaagacaagcacgaaagaataatactgtgccaggcgcggtggctcacgcctgtggtcccaacagtttgggaggccgaggcgggtggatcacttgaggccaggatttcgagattagcttggccaacatggtgaaaccccgtctctactaaaaatacgagaattagcgactcccagccgccgcccgggcccgcgcgctcctccgccgcgctccgctcggctcctctcgaccccacaccgccggtcgacatgatccgctgcggcctggcctgcgagcgctgccgctggatcctgaccctgctcctactcagcgccatcgccttcgacatcatcgcgctggccggccgcggctggctgcagtcgagcgaccgcgtccagacgtcctcgctgtggtggagatgtttccttccacaggggcggcggcggcggcagcgggtcctaagaggacggctgccacagcctcatggagtacgcgtggggtcgagcagcgctgccatgcttttctggggcgtcagcatcctggtgatctgtttcatcctctccttcttcgtcctgtgtgtaccccagatacttgtcttcctaagagtgattggaggtctccttgccttggctgctgtgttccagatcatctccctggtaatttaccccgtgaagtacactcaaccttcaaccttcatgccaagccccgctgtcacttccatctataactgggcctgcggctttgggtgggcagccatgattatcctcattggctgtgctttcttctgctgctgcctccccagctgcgaagatgacctcctgggcaataccaagcccaggtacttctacacatccgcctaacttgggaatgagtgtgggagaaaatcgccactgccaagatggactccagaagaagaaactgtttctctaggctacttcgaacttattttttggcagtgttcatattctcaaactagtcaaaaatgctaaaataatttgggagaaaatatttttaaagtagtgttatagtttcatgttcatcttttattatgttttgtgaagttgtgtcttttcactaattacctatactatgccaatatttccttatatctacccataacatttatgctatgtttgtaagagaatatgaacatgaaacttaacactttataaggtaaaaatgagatggtttccaagatttaataattggatcaagttcttgttatttccaaatagaatggacttggtctgttaagggctaaggagaagaggaaggtaatggtaaaaattgtcaatgactggccgggtgtggtggctcacgcttgtaatctcagcactttgggaggccgaggcaggccaatcacctgaggtcacaagttcaagaccagcctggcaaacatggtgaaacgccgtctctactgaaaatacaaaaattagccaggcttggtggcacatgcctgtagtcccagctactggggaggctgaggcaggagaatcgcttgaaccagagaggtggaggttgcagtgaaccgagattgtgccattgcactacagcctggtcaacagagcaagactctgtctcaaaacaaacaaaaattgtcaatgaccaaacattctaaaagaaatgccaaaaaaaaagctttttttttcaagccttcaaactatttaaggaagcaaaatagtttcctaaatgcatattgtttgtgagaatttctcattaatatcctgaataattctttttttttttttgagacggagtctcactctgtctcccaggctggagtgtgatggcgtgatctcggctcactgcaagctctgcctctcgggttcacgctatcctcccgcctcagcctcccgagtagctgggactacaggcgtccaccaccacgcccggctaattttttgtatttttagtagagacagggttttaccgtgttagccatgatggtctcgatctcctgacctcgtgatctgcccacctcagcctcccaaagtgccgggattacaggcgtgagccaccgcgcccagccctgaataattcattcttgctaagcttcatgttgactctatatatcatctaagaaagtattgttttgtggtccaaacctgttgccgtggttagtaaggctttcttaggtgtgaaatatttagatgaaattttctcttttaaagttctgtatagggttagggtgttggaaaatgctatattaataaatctgtagtgttttgtgtttataggttcagaaccagagtaactggattgaaagatggactgatagattagatatatcagtctaatttatcatgactgatagatctggttaagttgtgtactaaaggattaggagagcccttcctgtcacaaaagtgccactaaaacagcctaaggagaaaaatggcttgcttttctaaacttcagatgtatctgggctctaatcatatagacaggcttctgatagattgcaactgtaagtagaaacctacatatagttaaaatcctggtctttcttggtaaacagatttaaaatgtctgatgtaaaacatgccacaggagaattcagggatttgagtttccctgaatagcatatatatgatgcatcaaatgggttattactattttttaccatttccacttacataatgaaaaacaattcattttaaatatcacattattattttgtaagtcatggaaaagggcaattgaagttttcattatgaagttttcccaataaaccaggaattctaaacttgaaaaaaaaaaatagaattagccaggtatggttgcacaggcctgtaatcccagctacccgggaggctgaggcaggagaatcacctgaacctgagaggcagaggcttcagtgagccgaggccacaccactgcactccggccttggtgacagagactctgcctcgaaagataaaaataataatgaaagtaatattgggattatactgtacattctttcttacatgtatggtgaatatattttgacaataaatatctttacatcagttaaaataaccacctcatattttgttttatggaatataatattattttgttgtatgaagtcaaatattagattgaaccatatatctgaccattttttacctataaaaatagcagttacctgtagtcccagctacttaggaggctgaggcaggagaatcccttgagcacaggagttcaaggctacagtgagctatataattattcttttgttgtgggacattttggtcatttctaaattttcaccactgttgtgataaacctcttttagcg

SEQ ID NO: 158413 - DNA, 388 bp, Homo sapiens
  Payload ID: 11012
  Gene Symbol: NGRN
  Gene Name: neugrin, neurite outgrowth associated
  ENST ID: ENST00000411845
  CDS Start-End: 1-72
gaggcgcctggtgccccgcccaggaccctgacgtgggaagccatggagcagatacgatacttgtcttcctaagagtgattggaggtctccttgccttggctgctgtgttccagatcatctccctggtaatttaccccgtgaagtacactcaaccttcaaccttcatgccaagccccgctgtcacttccatctataactgggcctgcggctttgggtgggcagccatgattatcctcattggctgtgctttcttctgctgctgcctccccagctgcgaagatgacctcctgggcaataccaagcccaggtacttctacacatccgcctaacttgggaatgagtgtgggagaaaatcgccactgccaagatggactccagaagaagaaac

SEQ ID NO: 158414 - DNA, 5837 bp, Homo sapiens
  Payload ID: 11013
  Gene Symbol: NCAM1
  Gene Name: neural cell adhesion molecule 1
  Uniprot ID: P13591
  ENST ID: ENST00000316851
  CDS Start-End: 212-2788
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttcaataaaaattgaaagaaaaaagcta

SEQ ID NO: 158415 - DNA, 2510 bp, Homo sapiens
  Payload ID: 11013
  Gene Symbol: NCAM1
  Gene Name: neural cell adhesion molecule 1
  ENST ID: ENST00000401611
  CDS Start-End: 246-2423
cgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggacc

SEQ ID NO: 158416 - DNA, 1423 bp, Homo sapiens
  Payload ID: 11013
  Gene Symbol: NCAM1
  Gene Name: neural cell adhesion molecule 1
  ENST ID: ENST00000531817
  CDS Start-End: 1-498
gaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctaaaaacattgcacagaatcactgctgtaacatgttccaagctggtcttcataatgctctaatgaagtaagatgtgtgtggaggacctgaatctcctgaagaatccatatgagtatgcgtgcatgttcatagtgttcaagcatcaaagctgtgtgggagttttagattttataatatttctgcttgcacagaaaaaaaatggcatacatcccatcaagcagaacaagaaggcagaaagcagaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattc

SEQ ID NO: 158417 - DNA, 4922 bp, Homo sapiens
  Payload ID: 11013
  Gene Symbol: NCAM1
  Gene Name: neural cell adhesion molecule 1
  ENST ID: ENST00000621518
  CDS Start-End: 367-2652
tgtctctcttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctacaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtg

SEQ ID NO: 158418 - DNA, 5937 bp, Homo sapiens
  Payload ID: 11013
  Gene Symbol: NCAM1
  Gene Name: neural cell adhesion molecule 1
  ENST ID: ENST00000618266
  CDS Start-End: 367-2913
tgtctctcttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtcccaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttc

SEQ ID NO: 158419 - DNA, 502 bp, Homo sapiens
  Payload ID: 11013
  Gene Symbol: NCAM1
  Gene Name: neural cell adhesion molecule 1
  ENST ID: ENST00000524916
  CDS Start-End: 1-253
gcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctc

SEQ ID NO: 158420 - DNA, 6045 bp, Homo sapiens
  Payload ID: 11013
  Gene Symbol: NCAM1
  Gene Name: neural cell adhesion molecule 1
  ENST ID: ENST00000615285
  CDS Start-End: 367-3021
tgtctctcttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagaggtacatgcaccatggaactggcaagtgggcagacagaaaggacaggctggcagtgcaggtttcccaggatctcatgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtcccaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttc

SEQ ID NO: 158421 - DNA, 610 bp, Homo sapiens
  Payload ID: 11013
  Gene Symbol: NCAM1
  Gene Name: neural cell adhesion molecule 1
  ENST ID: ENST00000613217
  CDS Start-End: 212-610
gctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccag

SEQ ID NO: 158422 - DNA, 1260 bp, Homo sapiens
  Payload ID: 11013
  Gene Symbol: NCAM1
  Gene Name: neural cell adhesion molecule 1
  ENST ID: ENST00000526322
  CDS Start-End: 1-918
tacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctagggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaaccta

SEQ ID NO: 158423 - DNA, 2993 bp, Homo sapiens
  Payload ID: 11013
  Gene Symbol: NCAM1
  Gene Name: neural cell adhesion molecule 1
  ENST ID: ENST00000619839
  CDS Start-End: 339-2993
actatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagaggtacatgcaccatggaactggcaagtgggcagacagaaaggacaggctggcagtgcaggtttcccaggatctcatgagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatga

SEQ ID NO: 158424 - DNA, 1179 bp, Homo sapiens
  Payload ID: 11013
  Gene Symbol: NCAM1
  Gene Name: neural cell adhesion molecule 1
  ENST ID: ENST00000528590
  CDS Start-End: 1-1118
acaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagataaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagca

SEQ ID NO: 158425 - DNA, 2787 bp, Homo sapiens
  Payload ID: 11013
  Gene Symbol: NCAM1
  Gene Name: neural cell adhesion molecule 1
  Uniprot ID: P13591
  ENST ID: ENST00000621850
  CDS Start-End: 134-2419
caaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccaccggcatctgctagctcgtctacccctgttccattgtctccaccagatacaacttggcctcttcctgcccttgcaaccacagaaccagctaaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattc

SEQ ID NO: 158426 - DNA, 5967 bp, Homo sapiens
  Payload ID: 11013
  Gene Symbol: NCAM1
  Gene Name: neural cell adhesion molecule 1
  ENST ID: ENST00000615112
  CDS Start-End: 367-2943
tgtctctcttacctccttgatgttcggcactatttgtggccggcgtggtggaaggacacagtgaggttctcacccccgccccccgctcctcgctcccatcccagttccatcaaaacgaacccgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtcccaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattcaattcccacgtagactcttattttataggacgaatgccaaattgcagcttctgggggtagatctcaatttgcagtattcagacttctttttctttcttttacattcttttttctttctttctttctgccaactttgttttccagtgtttacaaggtgacaaatgtttgactttggttgtgtttaaatgtccgtgtaaaatagctgccttttattttttaaggtaacaaataccacctagaggtaggtaggatcatcccacgcttgctttagcacaggacaactttacaaaacatgattgtttacagctgctcttcccctcttttctgatctgcagtttttgcctgggtcccactcaggtgaaaatccatctcattctggaatggttttgcttttgaatttttggttatttttgtgtttctttgggggttagaccactttctgattagccgccacctgcctgcatctgtgaaaagggatctgctcccaggcgttctcacccttcttttgaaggactccttaggctttgttgaatgaagcagagaagattgtatagttggggctggtcttggtgaacacacattattaccccacacatcccctttgtgtagaaagccaaataaaatctatacataccatttccttttgagcccagaatctagatttgagcggaagagcatgtgtgcttcagggaattagtgtctttttttggaaatctgttgaagtaaagtaacatcggccttctgttcacttaggcagcatttatagaaacaaaagaagaaagaaacaacctactgtctggagtcataacacaactttcctggattggaaaccaagtgggggaaaaaatacagaaactttaagggggatgggaggggggggagaagggaaaagccagccctttgtatagaaattttgcttttttttccctcattctactttagaactgcaagcttgtgcactgtggatgcgtgaatattttagtgtgaaacgtgtttttgtcatagtattgaaataaaacttcaacatagtttggttgtggaaggtatagcagatagttcagaaaaaatattcaggaaacaaaaatcactcaaacggaatcgaagccttttaacaaagaaaatgaaatacagatgatgatgatgatgatgaagatgatgctaagtaaacagaaatcagtactccgcatgcgctcctctcctaaggtacaaagcagcaagaggttagggtggcaaggctgcctctgggtccattctgtgggccactctccccaacgttctgacacttctgcagtctgatcagtggcgatgctagattataatttcaaactgtgaagaataatggtcttgtcatttgctcaatgtggggttatgttgcattttctcagctcctggggatggaaatggaggatcccagaacacacagccctggcccctttgattctagggcctgcacagatctctggttcaaatgcacaggccctcagaatagaggaacatgaagagagatcttagagcacacagtagaatgtgagagcctgggtgtctgagaccgggagggcccagcagtgaggggcaggctcttctggtcaccaggctgttcagtggactcagttcttcatcttgtaatgtcgatggctttgccacaccaggccaagcccatgccataccttgtcaagactgtcaaagtggttgtggttaggtcaaactggttttggttctgatggttaggaagaaacaggtcagccctcagatcacctggcccgggacagctgaccccctagaaccctggctctgccattagctaggacctaagactctgcccacattttggtctgttctctcccattacacataggtttgtctcagcatgcaagagtttttcctttaaaaaaaaaaaaaaaaaaaaaaaaaaagcaatgctttctctaaaatcaaagagggagtcattttattccaagatgttttatcttttatgttaagagatcaaagcttataattttcttttttaatttttgaaggagggatcaactccagtttccaatgtctatgtgtctatgtgtgtatgtgccatacatatgtattcacatgaagaccggcatggccaagttctgctggaggagcactcaagtgtgacgagcagggccactggaccctgcagggctgtggtgtatatagtgcagctttggaggtggaactctattttcacacttttctatggagccttccgagtcccaggttttcacttgaggctgtctgtctggatggcggttttcagacctccattaacatccctacccagcattctgtacttcgggggccttctctcttgttataaaactttttaccaagtgaaacatcgataccacctttgtttccattctcactggtgtaaatactgagtactaactgagaattttgactttgcattctgtcggaatacttgtgttc

SEQ ID NO: 158427 - DNA, 4698 bp, Homo sapiens
  Payload ID: 11013
  Gene Symbol: NCAM1
  Gene Name: neural cell adhesion molecule 1
  Uniprot ID: P13591
  ENST ID: ENST00000621128
  CDS Start-End: 246-2426
cgggccagcgcaaggatctccgagttgcgagtgtgctgaggctgggactgtcactcattctccgatcagcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagcaaccttgggaggcaattctgcatcctacacctttgtctcattgcttttctctgcagtgactcttcttttgctctgttaggaacttgaacacaaaaattaaatttgcttaaaagcccagttcctatgaaaaagatcagtgccccctttggaagaacctggcaggaccaccatggccacagctgctgagcaaccattctgtgtggaagagaaggttttgtgattggaaaaagctttacctccagacatgtcaccactcacagatacttttgtgccacttcataaggagtttgccccctttttaatggcagtaaaaagaatttgagagctctttctttaaatgctatttttaaaaaccatcatgctagatttacagagaagtttctgcatatctgctacttgttgcattttgggttcaaacctaaatatgatgtagcagaggaagaattctaagtaccttctaaagcttgtgtcagattgttaaaatcaccacacattcccctcattctaactctgtgctccttgtcctcccttcaataataattggctttgcttgcaattaagcatttaagtgcccatgttaaaagagccagaccgcactgattcacatgagcgttttgctgacatgatgggcaactgaagtcacccctgttgcccatgcactggaaaaaaagttgaatttgttggatattttctggggctgatgaacgttctgggatgtgctttcagtcctcgtattacggccagcaccttacactgtctctgtgaacggggccaagccatgatgtgccaacaagtgtcagctttgaaaggtgtttgtctcccaatcggggtgactcccctgctgcctggcagcatgtcgcagatcagcacagagtggggccgtggttcagcagtgacccacagaatggctttgagcatcagtctacaggacaggttggaagcatccactgtgaaccaggcattagtcccctacctggcctgtgtgtgctcagtagagaaggagagggacaggccactcccagactgcccagcccaggagggttaataaattggggccgagccaacctgtcagtgcttcctgaatgccccagcctctgtattggtgcgttggttcagtgacattttctaaactctcctgaaaatccagctgctcctccctgctgcttgggagttcacccaggagaggaaatgggtgtgttttgttaaggtcccttgtggagactcagggctgaatcctgcttggtaatatcagtgtgtgtgcttggggatggaccttctactgaataaaaactccctccctccccccattgtggtcacatatcattctacatatctcatctctgagcatctccatggaagcttgatttttgttctttttggtttctttatgtatttttttctgttgttattattttttaatgttcaaagactagcctttccctttgggattccaaatgatcccatgctgtggtctgaggggcaaagccacctatgttggcgctcgccattaatccccagcgctcagtttagaggctcacgtgcagacatcagaggctccatgctgcacagtagctcaggcagggtagtgcctctcaacccagccacaaaactctccccgctggagtcccagatggcgcttcacaccagggcagtggaggcaggcatggtttttgggcacagggcagagcataaggatcccaggtcagtgtgggagagctactggctcttaggatcaccttgggcagaagtcacacggcttcatcctaggagggcccagcttgggagtctgcctccccctgatcccaggaccacccacaggagaggggcagtgtccatctttctgaagggaccctttggagatctcgtcctaagtgtggagaggactgacgtggccctgtcatctcaacacatcccagggtcaggcaggcctcagctgaaacaatgtcagggtcctcaagggtcccatttagacagacccacggcttgtaacagtgcgctcctcaggaggcagcactagcgcatacccactccccacggacactgagttcctggtgacagctgcagccccagccccgccaggagtcctggagacagcagccctcagagaccctgcaggagtgagtgcaccccaccttgctcagccacaccccactcccctgtgccctgtagttgtgctgcccatgctccacacaccatggggcccctttgctcatttttggactatttatacagcaggtttggatcatgtttttctactaataagaatgctaacattgttgtgtagataatcagtgagggctttatgaagtttacacctttgcattattaaaggaaataacagttcatgtgaa

SEQ ID NO: 158428 - DNA, 1843 bp, Homo sapiens
  Payload ID: 11013
  Gene Symbol: NCAM1
  Gene Name: neural cell adhesion molecule 1
  Uniprot ID: P13591
  ENST ID: ENST00000529356
  CDS Start-End: 177-1271
cgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaaggcttcgtggactcgaccagagaagcaagaggtatagcttacctgaccactagccagtctttagttttgaaagcattacagtttaactcaccattgcagtttaataaccagacatgctaaactaattagtaatttagctaaagaataggtcgatagtggtagacattacttagcaatagtatcattttaggatgagcaagcaagctgtgttgggagtggatgaacaaatccatattatttcctaaaactggatcttattctcttgctggtgctggtaaaatcacatccaggtaattacaccaatagaaataaattgcccccaattcccaggccaggcattttgaaatggtgaaagttttttgactcacatggttgatgtggctctggaccataaagtcacagagttagtgatctaaaaacccactcctccctttcctttccagctcaactcatcttgttgctcacttattttataatgatcagtcttggtaaattatcacatcacgtttcatctcaaaagcaatgcaaatgacatctctcgttggttttcccaaattgctaaacgtatctctgttacttttatagagcattaaatttatgagattagaa

SEQ ID NO: 158429 - DNA, 585 bp, Homo sapiens
  Payload ID: 11013
  Gene Symbol: NCAM1
  Gene Name: neural cell adhesion molecule 1
  ENST ID: ENST00000620046
  CDS Start-End: 179-585
agcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcct

SEQ ID NO: 158430 - DNA, 686 bp, Homo sapiens
  Payload ID: 11013
  Gene Symbol: NCAM1
  Gene Name: neural cell adhesion molecule 1
  ENST ID: ENST00000530543
  CDS Start-End: 1-686
acgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccatagccctcctccacgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgt

SEQ ID NO: 158431 - DNA, 2826 bp, Homo sapiens
  Payload ID: 11013
  Gene Symbol: NCAM1
  Gene Name: neural cell adhesion molecule 1
  Uniprot ID: P13591
  ENST ID: ENST00000531044
  CDS Start-End: 178-2724
gcgcgtgaacgcagctcggctgccgctggcaggaaacaattctgcaaaaataatcatactcagcctggcaattgtctgcccctaggtctgtcgctcagccgccgtccacactcgctgcaggggggggggcacagaatttaccgcggcaagaacatccctcccagccagcagattacaatgctgcaaactaaggatctcatctggactttgtttttcctgggaactgcagtttctctgcaggtggatattgttcccagccagggggagatcagcgttggagagtccaaattcttcttatgccaagtggcaggagatgccaaagataaagacatctcctggttctcccccaatggagaaaagctcaccccaaaccagcagcggatctcagtggtgtggaatgatgattcctcctccaccctcaccatctataacgccaacatcgacgacgccggcatttacaagtgtgtggttacaggcgaggatggcagtgagtcagaggccaccgtcaacgtgaagatctttcagaagctcatgttcaagaatgcgccaaccccacaggagttccgggagggggaagatgccgtgattgtgtgtgatgtggtcagctccctcccaccaaccatcatctggaaacacaaaggccgagatgtcatcctgaaaaaagatgtccgattcatagtcctgtccaacaactacctgcagatccggggcatcaagaaaacagatgagggcacttatcgctgtgagggcagaatcctggcacggggggagatcaacttcaaggacattcaggtcattgtgaatgtgccacctaccatccaggccaggcagaatattgtgaatgccaccgccaacctcggccagtccgtcaccctggtgtgcgatgccgaaggcttcccagagcccaccatgagctggacaaaggatggggaacagatagagcaagaggaagacgatgagaagtacatcttcagcgacgatagttcccagctgaccatcaaaaaggtggataagaacgacgaggctgagtacatctgcattgctgagaacaaggctggcgagcaggatgcgaccatccacctcaaagtctttgcaaaacccaaaatcacatatgtagagaaccagactgccatggaattagaggagcaggtcactcttacctgtgaagcctccggagaccccattccctccatcacctggaggacttctacccggaacatcagcagcgaagaaaagactctggatgggcacatggtggtgcgtagccatgcccgtgtgtcgtcgctgaccctgaagagcatccagtacactgatgccggagagtacatctgcaccgccagcaacaccatcggccaggactcccagtccatgtaccttgaagtgcaatatgccccaaagctacagggccctgtggctgtgtacacttgggaggggaaccaggtgaacatcacctgcgaggtatttgcctatcccagtgccacgatctcatggtttcgggatggccagctgctgccaagctccaattacagcaatatcaagatctacaacaccccctctgccagctatctggaggtgaccccagactctgagaatgattttgggaactacaactgtactgcagtgaaccgcattgggcaggagtccttggaattcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccaaggggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaa

SEQ ID NO: 158432 - DNA, 1758 bp, Homo sapiens
  Payload ID: 11013
  Gene Symbol: NCAM1
  Gene Name: neural cell adhesion molecule 1
  ENST ID: ENST00000528158
  CDS Start-End: 1-1405
gtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagctgcctgccgacactacggccactgtcgaggacatgctgccttctgtcaccaccgtcaccactaactctgacactatcaccgaaacctttgccactgctcagaacagccccaccagtgagaccaccaccctgacctccagtattgccccgccggccacggccacgcctgactcaaactctgtaccggctggccaggccaccccttccaaggggcccagcgcctctgccccctccccggccccagcttcagcccccaaggtcgcccccctcgttgacctgagcgacaccccgacctcaacccctgccgctagcaatttgtcttctagtgtcctggctaaccaaggggctgtcctcagcccaagcgcccctgctggtgtcggggaggcctctaaggctcctccggccagcaagcccacccctgcaccagtccccaccccgactggggcagccagtcctctagcagcagcggctgcccctgccacagaagcccctcaggccaagcaggaggctcccagcaccaaaggcccggacccggagcccacccagcccggagccgcgaagagcccggccgaggcagccacagcccttgctagcccgaagagcgaggctgcctccgtcagcaccacaaacccttcccagggcgaggactttaaaatggacgaagggaacttcaagaccccagatattgaccttgcaaaggatgtttttgcagccctgggctctcctgctcccgccgctggggccagtggacaagcccctgagcttgctccttccactgcagacagctctgtttcgcctgcgccagcaaagaccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaa

SEQ ID NO: 158433 - DNA, 1648 bp, Homo sapiens
  Payload ID: 11013
  Gene Symbol: NCAM1
  Gene Name: neural cell adhesion molecule 1
  ENST ID: ENST00000533073
  CDS Start-End: 1-1072
attcatccttgttcaagcagacaccccctcttcaccatccatcgaccaggtggagccatactccagcacagcccaggtgcagtttgatgaaccagaggccacaggtggggtgcccatcctcaaatacaaagctgagtggagagcagttggtgaagaagtatggcattccaagtggtatgatgccaaggaagccagcatggagggcatcgtcaccatcgtgggcctgaagcccgaaacaacgtacgccgtaaggctggcggcgctcaatggcaaagggctgggtgagatcagcgcggcctccgagttcaagacgcagccagtccgggaacccagtgcacctaagctcgaagggcagatgggagaggatggaaactctattaaagtgaacctgatcaagcaggatgacggcggctcccccatcagacactatctggtcaggtaccgagcgctctcctccgagtggaaaccagagatcaggctcccgtctggcagtgaccacgtcatgctgaagtccctggactggaatgctgagtatgaggtctacgtggtggctgagaaccagcaaggaaaatccaaggcggctcattttgtgttcaggacctcggcccagcccacagccatcccagccaacggcagccccacctcaggcctgagcaccggggccatcgtgggcatcctcatcgtcatcttcgtcctgctcctggtggttgtggacatcacctgctacttcctgaacaagtgtggcctgttcatgtgcattgcggtcaacctgtgtggaaaagccgggcccggggccaagggcaaggacatggaggagggcaaggccgccttctcgaaagatgagtccaaggagcccatcgtggaggttcgaacggaggaggagaggaccccaaaccatgatggagggaaacacacagagcccaacgagaccacgccactgacggagcccgagaagggccccgtagaagcaaagccagagtgccaggagacagaaacgaagccagcgccagccgaagtcaagacggtccccaatgacgccacacagacaaaggagaacgagagcaaagcatgatgggtgaagagaaccgagcaaagatcaaaataaaaagtgacacagcagcttcaccagagcatttccaacaccacagacacacacacgcacgcacacacacaaacacacatgcacacacacacatctcatttctctagtgtcttttgcctttaaaaaaaactaaacagataaaacatgggaatctcctttttgtaggtttatagaaagggtccctttgttgcacactcacttgtaagaaaatgagacaaaaaggttaaacccacagccaaactaggacactccgttccctgaaaccgttaaaaaatcaaacaaaaggaccccaaattaagaatctaggaagctcagaaacgaaatctaggttcaggaagaccacacttggtgttacccgattggcacagaccagtttcagagaaatactttcaggcactaagactaatcgaatgaacaaagtccacagtttatttttatactttcagtcaagtttgaactctgtaaaacctcataaataagttataatttctgttcactttgtatttgttcagtatgcaaagtgtgtcaccctttctagctgaattc

SEQ ID NO: 158434 - DNA, 4699 bp, Homo sapiens
  Payload ID: 11014
  Gene Symbol: NCAM2
  Gene Name: neural cell adhesion molecule 2
  ENST ID: ENST00000284894
  CDS Start-End: 2-2461
agctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcgggaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgttcatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtg

SEQ ID NO: 158435 - DNA, 8135 bp, Homo sapiens
  Payload ID: 11014
  Gene Symbol: NCAM2
  Gene Name: neural cell adhesion molecule 2
  Uniprot ID: O15394
  ENST ID: ENST00000400546
  CDS Start-End: 250-2763
gctgccgccgcggcggccgctgctgctgctgcttctgccgccgctgccgccgccgctgcctggatatagtgcggcaagagcggagcttgcagtcactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcgggaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgttcatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtgacatttctgtttctctcatttattcggattttccttgtaaagaaattgacatatatttcatatatatatacacatatatatatatacacatatatatacatatatatatatgatgttaaatttcctgccactcatgtggagtaatgatctgaaattaacagataatctgaagctaattatattcagactatttcaagtgcactgtttcagttgcccgggtggtccttacctcttgtccttgaaatccatgccatgctgaagcaaggcaatactgtgataaagtattttttttaatatttcaatggaatgctccaaatgatttataaaaatttcaaaataaaagatggcttgtagtaaattgtaaaatatgagtagaactgaaataacctgtttcattcttattctagattaaacaaacatatacatataaccatataaatgttatttttattgtctgagagtactcttaaatattagtataaagtgtcaaaagaattgactgaatataagtactgttaaaataatttgaaccctatgatattttaaaccaagaggcaaagatatcacctaaaacttggtatttcttgataggttaggtgcaattaggcagtgacaatctgtattcaacaacatataagaggaaagagtaatatcagaattttgacacaaattaatgtgtcaacatattttacaatgattgtcaaaggaatttaagaattgtatttttaaagatttatttattatttttgtgggctaagacattgccattctattgatactaatgtctaacattaatgtttcttgttttcttttatttttaatattaataactataaaagcatttttcaaaggctatttgatccagcacacttcatatggatcttagtctttgaattaaatatttatataaatagattttattaatcaaattatttatttgtgtgccaacaattaattgtaactttatgatcatatctttgtttatgcttcttattttaaataattaagatgtatctgtgccttttaattagcatgacagtctgctttattaaaagaaaaaaactacaattaacatcattactagtatattttgcttagatttgagatactcaaatgatgctgtcttatttacagtcagtaattaagttcaattcaaactattttaccttgaatataaaatctaaatataataaactatactgtataatttactttaattcatgtcaaaacaattctttttatacacacacatgaaatattcttaatctgttctgtattgtttttctaaacaataaatacattctagatattgttgaaattaaattttgccagttgtaagacaaagacaacagataacttttgaaaatcaagcaaattactatggtgtttcttgggtcttcattattccatttatatatattttttatttcgaataataaatcaacctttatttttggcaataagattatcactgacgaaaatatgtacagttcaagaagtagaaataatattttccattagttaatttaggaaatattggaatagcatattataattatttatgaggttcccaatgttgtttttcacagaaaataaggtaaacattcaacttaaatcccccatgaagttttttcatgctcatactcataatcattatcacataatgtgcttattcaacaaactttgtatctggatatatttttaacaataagtttgttagcattatttatttatctttagagagaaaatatttgcatctgtttatttaccctttgaagcattaatacttagtcactcacattgaaattgcatatggatgtatcaacataggctaaaattaaattatggatgtcgcagaaatgaaatacttcatcttagaaggtaaaattttcaagaaagtattttattcatggacttaataatgtcttaagatgaaacaattttatgtccaaatgagaaatttataaaaagacccacatatagtagttgctgaacaaacataattttcttccagctcccatccttcctttttgaaaaattgaatttacccatgtagatgcagctatttacaattatacaagaatgcgaatagattaattatatcttctcatataaaggcaaagaattttatattatatataatgctaaatatttatttgataacacaatattcttagaaaaatagtttattactttaggattttatctataacataaatatattatttgttattacctctttaaattttcattttatacaatttttgagattctggccacacaacattcagaattattgctcatgtaaatttaaatattgctacttattttttttcttttctgaaatgaaaacatgaatcttttggcatctgtttttagcctcccatggaagacagtaagcaaaaccatcactgttggagaatttcaaatcacaacccgacataggagagtagagaaacaaagaaatgagtggatctagaaaggcaaactgaattgctatatttggaatagctaagaaggacctgactttgagaagtgctagaccagggactaggaacgttgcttagataaaaattatggccgattacactgatgcgaaggagaaaacagtgtaacacagaggagaaagttaacagagatagaatctatgatttaattttgcaaatagtttttttagagaacaacatgcatactataaaagaaatgatactattaagaacaaacctacttgttccaactcttaaagaaatattcatggtttagcatttgcctctaaaccctgttagaaatatgtgaagttagaaataaaggtttttttaaaaaaaaagcttttttggtatgtgaactgtatgctgtgctcagtatgtactgaaacatactatcttttattttctttaatttatatattccattcaaattctatattcttaagttagctaccacaacgttttcttattgtttcaatatggtatgtcccaatgaaatgctgtatatatatgtctaaactgtaaaaattatactgcaaatgttgaagttttgtatttatgagagacattgaaagtatggcttacagtatatcaaacttgtcacacttcaccatttgtatattaatagtaaagatacttttactttaa

SEQ ID NO: 158436 - DNA, 3329 bp, Homo sapiens
  Payload ID: 11015
  Gene Symbol: NELL1
  Gene Name: neural EGFL like 1
  ENST ID: ENST00000298925
  CDS Start-End: 154-2670
atatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagcagaagatatgaagccacccgtgttatcgctgatatggagaactagagttctgaagtctctgcttcagcaatcccttcagggagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttttgtcccatctactgcatacttagtgctgagatccctgtaaaatgttttgatgaaaatatgtatgtagagtccagtcgcattatacatacatttcatagtgctgaaccttcttaaatgcctactcattcagcttaaacaggctgaagccaagtatgacaaagaggggaagggccaaaaacataatcaaagaataattttaaagagaattcttgtctctcttgc

SEQ ID NO: 158437 - DNA, 3094 bp, Homo sapiens
  Payload ID: 11015
  Gene Symbol: NELL1
  Gene Name: neural EGFL like 1
  ENST ID: ENST00000325319
  CDS Start-End: 174-2435
ggggctgccttcccgggcgcatatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttttgtcccatctactgcatacttagtgctgagatccctgtaaaatgttttgatgaaaatatgtatgtagagtccagtcgcattatacatacatttcatagtgctgaaccttcttaaatgcctactcattcagcttaaacaggctgaagccaagtatgacaaagaggggaagggccaaaaacataatcaaagaataattttaaagagaattcttgtctctcttgc

SEQ ID NO: 158438 - DNA, 3022 bp, Homo sapiens
  Payload ID: 11015
  Gene Symbol: NELL1
  Gene Name: neural EGFL like 1
  Uniprot ID: Q92832
  ENST ID: ENST00000357134
  CDS Start-End: 153-2585
tatgcgagcgcagcacccggcgctgccgagccacctcccccgccgcccgctagcaagtttggcggctccaagccaggcgcgcctcaggatccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtgacttt

SEQ ID NO: 158439 - DNA, 2400 bp, Homo sapiens
  Payload ID: 11015
  Gene Symbol: NELL1
  Gene Name: neural EGFL like 1
  Uniprot ID: Q92832
  ENST ID: ENST00000532434
  CDS Start-End: 64-2355
tccaggctcatttgcttccacctagcttcggtgccccctgctaggcggggaccctcgagagcgatgccgatggatttgattttagttgtgtggttctgtgtgtgcactgccaggacagtggtgggctttgggatggaccctgaccttcagatggatatcgtcaccgagcttgaccttgtgaacaccacccttggagttgctcaggtgtctggaatgcacaatgccagcaaagcatttttatttcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctaaatcacacttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgacca

SEQ ID NO: 158440 - DNA, 2746 bp, Homo sapiens
  Payload ID: 11015
  Gene Symbol: NELL1
  Gene Name: neural EGFL like 1
  ENST ID: ENST00000619031
  CDS Start-End: 602-2314
atcagggactgacattgcttcatgactcctggctgctgtggaaaataatttttcccctccttctgatagcaagacatagaaagagagatccatgcagctcctcatgtgagtgagaaattaattcagctgttccggaacaagagtgaattcaccattttggccactgtacagcagaagccatccacttcaggagtgatactgtccattcgagaactggagcacagctattttgaactggagagcagtggcctgagggatgagattcggtatcactacatacacaatgggaagccaaggacagaggcacttccttaccgcatggcagatggacaatggcacaaggttgcactgtcagttagcgcctctcatctcctgctccatgtcgactgtaacaggatttatgagcgtgtgatagaccctccagataccaaccttcccccaggaatcaatttatggcttggccagcgcaaccaaaagcatggcttattcaaagggatcatccaagatgggaagatcatctttatgccgaatggatatataacacagtgtccaaatctcttgcccaacctgcagtgatttcttaagcctggtgcaaggaataatggatttacaagagcttttggccaagatgactgcaaaactaaattatgcagagacaagacttagtcaattggaaaactgtcattgtgagaagacttgtcaagtgagtggactgctctatcgagatcaagactcttgggtagatggtgaccattgcaggaactgcacttgcaaaagtggtgccgtggaatgccgaaggatgtcctgtccccctctcaattgctccccagactccctcccagtgcacattgctggccagtgctgtaaggtctgccgaccaaaatgtatctatggaggaaaagttcttgcagaaggccagcggattttaaccaagagctgtcgggaatgccgaggtggagttttagtaaaaattacagaaatgtgtcctcctttgaactgctcagaaaaggatcacattcttcctgagaatcagtgctgccgtgtctgtagaggtcataacttttgtgcagaaggacctaaatgtggtgaaaactcagagtgcaaaaactggaatacaaaagctacttgtgagtgcaagagtggttacatctctgtccagggagactctgcctactgtgaagatattgatgagtgtgcagctaagatgcattactgtcatgccaatactgtgtgtgtcaaccttcctgggttatatcgctgtgactgtgtcccaggatacattcgtgtggatgacttctcttgtacagaacacgatgaatgtggcagcggccagcacaactgtgatgagaatgccatctgcaccaacactgtccagggacacagctgcacctgcaaaccgggctacgtggggaacgggaccatctgcagagctttctgtgaagagggctgcagatacggtggaacgtgtgtggctcccaacaaatgtgtctgtccatctggattcacaggaagccactgcgagaaagatattgatgaatgttcagagggaatcattgagtgccacaaccattcccgctgcgttaacctgccagggtggtaccactgtgagtgcagaagcggtttccatgacgatgggacctattcactgtccggggagtcctgtattgacattgatgaatgtgccttaagaactcacacctgttggaacgattctgcctgcatcaacctggcagggggctttgactgtctctgcccctctgggccctcctgctctggtgactgtcctcatgaaggggggctgaagcacaatggccaggtgtggaccttgaaagaagacaggtgttctgtctgctcctgcaaggatggcaagatattctgccgacggacagcttgtgattgccagaatccaagtgctgacctattctgttgcccagaatgtgacaccagagtcacaagtcaatgtttagaccaaaatggtcacaagctgtatcgaagtggagacaattggacccatagctgtcagcagtgtcggtgtctggaaggagaggtagattgctggccactcacttgccccaacttgagctgtgagtatacagctatcttagaaggggaatgttgtccccgctgtgtcagtgacccctgcctagctgataacatcacctatgacatcagaaaaacttgcctggacagctatggtgtttcacggcttagtggctcagtgtggacgatggctggatctccctgcacaacctgtaaatgcaagaatggaagagtctgttgttctgtggattttgagtgtcttcaaaataattgaagtatttacagtggactcaacgcagaagaatggacgaaatgaccatccaacgtgattaaggataggaatcggtagtttggtttttttgtttgttttgtttttttaaccacagataattgccaaagtttccacctgaggacggtgtttggaggttgccttttggacctaccactttgctcattcttgctaacctagtctaggtgacctacagtgccgtgcatttaagtcaatggttgttaaaagaagtttcccgtgttgtaaatcatgtttcccttatcagatcatttgcaaatacatttaaatgatctcatggtaaatgttgatgtattttttggtttattttgtgtactaacataatagagagagactcagctccttttatttattttgttgatttatggatcaaattctaaaataaagttgcctgttgtg

SEQ ID NO: 158441 - DNA, 2943 bp, Homo sapiens
  Payload ID: 11016
  Gene Symbol: NELL2
  Gene Name: neural EGFL like 2
  Uniprot ID: Q99435
  ENST ID: ENST00000333837
  CDS Start-End: 93-2612
agaaggatccatctaacatttactgaaataaggaagatgctttattcaatctaaaagtgaaaaaagaaccttttagacattattattataaaatgtctataagaagacttctcattttaatcctcaaaatagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcag

SEQ ID NO: 158442 - DNA, 3203 bp, Homo sapiens
  Payload ID: 11016
  Gene Symbol: NELL2
  Gene Name: neural EGFL like 2
  Uniprot ID: Q99435
  ENST ID: ENST00000395487
  CDS Start-End: 97-2544
gtgcttgccttggagaccgcgaggcggatcacgcccctagtccagggtcggagggctgagggggaactttgcagagagaagggtttaaaggaggtcatggaaacgggactgggtgctccgctatttaaagcttggctgctgatctcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataacac

SEQ ID NO: 158443 - DNA, 3612 bp, Homo sapiens
  Payload ID: 11016
  Gene Symbol: NELL2
  Gene Name: neural EGFL like 2
  Uniprot ID: Q99435
  ENST ID: ENST00000429094
  CDS Start-End: 506-2956
ggcccgcccctccctccccggaggagcagtctctccgcgcgtctcccggagctttctccattgtctctgcctttacaacaggttcgggcggcggggaagacgggggggtgcggggccgccccagcccgggctttcttggggccgccccccttctaccgggtgtgcgagtctttggctgcttttattcggctcgggagctaattccccgacggagccgcgccggggcgagtccgacccctccctccgggccccctccgggccgcgctgccgcctcggccctgcgtgtgggaatgatgtgcgcattggagggtctaagttcttcacgcgcctggggaggcctcccttttctttcttaggcaaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttaccttataa

SEQ ID NO: 158444 - DNA, 3196 bp, Homo sapiens
  Payload ID: 11016
  Gene Symbol: NELL2
  Gene Name: neural EGFL like 2
  Uniprot ID: Q99435
  ENST ID: ENST00000452445
  CDS Start-End: 94-2544
ggaggagcagtctctccgcgcgtctcccggagctttctccattgtctctgcctttacaacagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttacctt

SEQ ID NO: 158445 - DNA, 3279 bp, Homo sapiens
  Payload ID: 11016
  Gene Symbol: NELL2
  Gene Name: neural EGFL like 2
  Uniprot ID: Q99435
  ENST ID: ENST00000437801
  CDS Start-End: 373-2973
gctcagttccccttgccttctgctgtatgctggtcccagagagcccgagtccgggtctccacgctttatttggcagggggcgcgcgggttccggagctgtccagcacctcctggccaagttctctgcgctctccgcgcccgggaagctctccgcgccggggaagctctccagcgccccgcccccggcagggaacctctccaccaggacacccggggcttcccaggctcgccatccgtccccaccagtctctacctactttgcccagctccacctcggcagtgcagcgtgttttggtggccttcctccgcacgccctggagggggagtgccctgcaccccggggctgctccggagcccagtgcacgagtgcacatgggcttccctcctttgcttaaagggcaggcgagcgctactcgctccagccttgcctcctgcagctgggtggtcttttttctctcctgtctttcaagacacgcgcccgaaatcgagggagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtg

SEQ ID NO: 158446 - DNA, 500 bp, Homo sapiens
  Payload ID: 11016
  Gene Symbol: NELL2
  Gene Name: neural EGFL like 2
  ENST ID: ENST00000551949
  CDS Start-End: 434-500
acttctttggatgctattttgaggatagactgaagggaatgatgatagcagggagaccagttaggatgatgacttagaccatggcagttgtgggtggagatggtaactgccagattctgtctatatattgagaagtagcaggcaggatgtactgagcaattggatgtgggatgtgagagaaatgactccaaggtttttggcctgagcaatcagaaggatccatctaacatttactgaaataaggaagatgctttattcaatctaaaagtgaaaaaagaaccttttagacattattattataaaatgtctataagaagacttctcattttaatcctcaaaatcactctggttatggattcctataagtgtatcctgttgaagtttgctgagctccttgaatctagggagacgatggactgagctgatccgcaccatggagtctcgggtcttactgagaacattctgtttgatcttcggtctcggagcagtttgggggcttg

SEQ ID NO: 158447 - DNA, 1053 bp, Homo sapiens
  Payload ID: 11016
  Gene Symbol: NELL2
  Gene Name: neural EGFL like 2
  ENST ID: ENST00000552993
  CDS Start-End: 91-1053
aaaccacatgtgaactgaagctgtcaggttccacaaaggcagaagtactctctgaaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtat

SEQ ID NO: 158448 - DNA, 569 bp, Homo sapiens
  Payload ID: 11016
  Gene Symbol: NELL2
  Gene Name: neural EGFL like 2
  ENST ID: ENST00000553120
  CDS Start-End: 70-569
tcttcagttcccaatattgtcgcgaaaacgcggttctttgctgccctggaggaagagacttgcattttgatggagcttttcctttttctctctcccacctcatacccctcaccagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataa

SEQ ID NO: 158449 - DNA, 3036 bp, Homo sapiens
  Payload ID: 11016
  Gene Symbol: NELL2
  Gene Name: neural EGFL like 2
  Uniprot ID: Q99435
  ENST ID: ENST00000549027
  CDS Start-End: 190-2637
attgtctctgcctttacaacagagggagacgatggactgagctgatccgcaccatggagtctcgggtcttactgagaacattctgtttgatcttcggtctcggagcagaccgcgaggcggatcacgcccctagtccagggtcggagggctgagggggaactttgcagagagaagggtttaaaggaggtcatggaaacgggactgggtgctccgctatttaaagcttggctgctgatctcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtca

SEQ ID NO: 158450 - DNA, 749 bp, Homo sapiens
  Payload ID: 11016
  Gene Symbol: NELL2
  Gene Name: neural EGFL like 2
  ENST ID: ENST00000550139
  CDS Start-End: 1-259
tgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcaggttggtataaatgaaaaactttaattaattttattcagttgtaatttgcatatgttttaagtgtgtatatggcttgatgagttttgacaatgtgtacatccacttacctaccatcacaattaatataacagaacacttccattatcccaaatgttgcctatgttctttcctagttagtcccacaaccttagatccaggcaaaaactgcatccagtccctattgattaaatttgtattttctagagcctcatataaatggagttttatagtatatactatattgtgtctgacttcattctctcaacattatgtttttgagattcaatcctattgtacctatatctctaatccatttctttttaataccgaataatatttcattgtatggatataccaatgtatttatctatccacatgttgataaaattttattactaaccatgctaattttttcctagtcacagtatcatgtttgaatgactgcataaataaagtcagaatgaacatgctgtga

SEQ ID NO: 158451 - DNA, 736 bp, Homo sapiens
  Payload ID: 11016
  Gene Symbol: NELL2
  Gene Name: neural EGFL like 2
  ENST ID: ENST00000550313
  CDS Start-End: 1-736
cagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacac

SEQ ID NO: 158452 - DNA, 559 bp, Homo sapiens
  Payload ID: 11016
  Gene Symbol: NELL2
  Gene Name: neural EGFL like 2
  ENST ID: ENST00000548826
  CDS Start-End: 148-486
aaccaaagcgtattaatcctactgatcagtaaatccgaggcagcagcaggagagacaaacgttattttcccgcttgattccaagaacctcttcgatttttatttttatttttaaagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtaaatgtggttgctggagtttcctgtgttttcattatatgtggttaaatgaatatattaaagagaagtaaacaaaa

SEQ ID NO: 158453 - DNA, 586 bp, Homo sapiens
  Payload ID: 11016
  Gene Symbol: NELL2
  Gene Name: neural EGFL like 2
  ENST ID: ENST00000548531
  CDS Start-End: 255-586
gagtggccgcagagctggggctggggaaagggatggctcccgcctcggggcagcatgggctggctggggaagcctcgcttttcccggacccaaagtaggtctggagtgggaagcttggagtaagggggcgggtttggatatggattttttttttttctgtgcttgccttggagaccgcgaggcggatcacgcccctagtccagggtcggagggctgagggggaactttgcagagagaagggtttaaaggaggtcatggaaacgggactgggtgctccgctatttaaagcttggctgctgatctcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacag

SEQ ID NO: 158454 - DNA, 3148 bp, Homo sapiens
  Payload ID: 11016
  Gene Symbol: NELL2
  Gene Name: neural EGFL like 2
  ENST ID: ENST00000551601
  CDS Start-End: 190-2496
attgtctctgcctttacaacagagggagacgatggactgagctgatccgcaccatggagtctcgggtcttactgagaacattctgtttgatcttcggtctcggagcagaccgcgaggcggatcacgcccctagtccagggtcggagggctgagggggaactttgcagagagaagggtttaaaggaggtcatggaaacgggactgggtgctccgctatttaaagcttggctgctgatctcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcaagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttacctt

SEQ ID NO: 158455 - DNA, 451 bp, Homo sapiens
  Payload ID: 11016
  Gene Symbol: NELL2
  Gene Name: neural EGFL like 2
  ENST ID: ENST00000550462
  CDS Start-End: 1-369
tgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatgtgagcataacttttatgatgaatactttctttggaaaaataaagcactgtattaataagtattcacccatcattggtttaatctgggcaagctaaatagctttcagaagtgatggaataaaggaagaatactttctc

SEQ ID NO: 158456 - DNA, 4046 bp, Homo sapiens
  Payload ID: 11017
  Gene Symbol: NEDD1
  Gene Name: neural precursor cell expressed, developmentally down-regulated 1
  Uniprot ID: Q8NHV4
  ENST ID: ENST00000266742
  CDS Start-End: 340-2322
gaagtttaacagtccaggcgggagccggaagcccagcgcggagccggccgcggccccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactgtgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattacttttacccagtgtggtttatagcatacatttgtactgaagcatatagggatgttaatgtgatcttttcctgacagattatgaaagcattatgacttgtaacaagtttccttgtatatcactaacaggtttagaagacataaatattagtgtgttttgcctacatggtgtatttaaatctattaatattttcctgttgcttttttaaaaaaataaatacacataatgtatattaaaagaggtgggatgaaataattttagtaattatgtgtacagatgaaacatttttgtcatggaatttaaaagctaagtaagtataaaaaataaaatgttatatgcaaaaaataggaaacatgaaattgaaatttcattgttggccaaaatgatatgagagatttaccttcccacctgaaattaaaaaagaaaatatgtg

SEQ ID NO: 158457 - DNA, 3366 bp, Homo sapiens
  Payload ID: 11017
  Gene Symbol: NEDD1
  Gene Name: neural precursor cell expressed, developmentally down-regulated 1
  Uniprot ID: Q8NHV4
  ENST ID: ENST00000429527
  CDS Start-End: 86-2068
aagtttaacagtccaggcgggagccggaagcccagcgcggagccggccgcggccccctgttgtgttgctgcggagaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactgtgtacctttgtatagctcttctgccccattttgacttctgagatgaaagtatttactaaaattaaaaaaaaaaaaacaaaaaacaaacctttagctcactaactttatgggtttctgaagtgatggaaatttttaaggatatatttaataagcataaacttactaataattacttccaaaaataaaaacaggaatattactttta

SEQ ID NO: 158458 - DNA, 3162 bp, Homo sapiens
  Payload ID: 11017
  Gene Symbol: NEDD1
  Gene Name: neural precursor cell expressed, developmentally down-regulated 1
  Uniprot ID: Q8NHV4
  ENST ID: ENST00000457368
  CDS Start-End: 279-1994
aatgtgagccatttttgaaagctactctgtaagctatactcattgcttgtcttcttagtgtgttagcttttataatcgcaattcttataatagtctagtgctatagatgttcatggattgtttgatgctccataactcctcatttagataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggagaaagtaattttaaaatggcaattggtgtttctaagccattgactaataaaacatagggttggctagtaattattttgttaacttgatgaagtcaagtatgactattatttattgtacatttgataagacaatttttggaattttgaattgcacaaattacatgatatcttttgcatttatgttactatattgtacttctgacaaatctttattcctgggtggtatttttaagatatctttacctataaaaaatgtttaaggttcataggactcgacaagagctatctggtgattttctcattagtaacatgcaacgttgtactgcaaaatttcaatcaacatgacaacttataatgagtggagatttcatattaggtactaaatattatagtattatttctattttctttttccaaataagaagcttggattattttattttgtggtctttatcattaactttaattctttctgtactgtgtataatatttttatattattggccttaccataaaattatttagaaaggttgtcaaaataagttatacctctttggcaatagatagatgtatacatctacctactatgatctacaattttaggttaagtgaagcttgggggggctactgacttggttaccttcttgtctcttgtcccaaagatttaaactgtgtacctttgtatagctcttctgccccattttgacttctgagatgaaagtatttactaaaattaaaaaaaaaaaa

SEQ ID NO: 158459 - DNA, 2490 bp, Homo sapiens
  Payload ID: 11017
  Gene Symbol: NEDD1
  Gene Name: neural precursor cell expressed, developmentally down-regulated 1
  Uniprot ID: Q8NHV4
  ENST ID: ENST00000411739
  CDS Start-End: 353-2068
aggcgggagccggaagcccagcgcggagccggccgcggccccctgttgtgttgctgcggagaggtacttggatgcattttacaggttagcctcacttgagctgttgtcctgcaagtaaagtgtatttttggtgattgaaagttggagaactttcatttcagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgagcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaagtcaacaggatctttattttttgaaagctttagccatccactaagtgccctttttcataagagaagaaaattgtgcataaaaattggttatgtttgttttttagtcatcttttttaacatatatttttgattgacaaattgcctttcaaatttttggggctagttgagatttaaagagtttgatatgccttctatttttatggag

SEQ ID NO: 158460 - DNA, 554 bp, Homo sapiens
  Payload ID: 11017
  Gene Symbol: NEDD1
  Gene Name: neural precursor cell expressed, developmentally down-regulated 1
  ENST ID: ENST00000557092
  CDS Start-End: 253-554
agtccaggcgggagccggaagcccagcgcggagccggccgcggccccctgttgtgttgctgcggagaggtacttggatgcattttacagctgagtggtgtagttgaattggttcctgtagccgctgtccctaaacccaggccgacgttaccgccttgtgtcctgactgctagctttcgacgggaccgtctttgagggactcatgtaaagtctctcccttaatgctcagttcttagaagaccgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgt

SEQ ID NO: 158461 - DNA, 565 bp, Homo sapiens
  Payload ID: 11017
  Gene Symbol: NEDD1
  Gene Name: neural precursor cell expressed, developmentally down-regulated 1
  ENST ID: ENST00000555806
  CDS Start-End: 126-371
agtccaggcgggagccggaagcccagcgcggagccggccgcggccccctgttgtgttgctgcggagaggtacttggatgcattttacagcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccaggctctccaatccagtgttgaatagaagtgatgatagtggacatctttattttgtccccaaattctggaagaagcattcaatttactaccaagcatgatagtcattgtaaggctagtgaaaactttagtggctgacactcctctaactgcggtagatttcatgcctgatggagccactttggctattggatcttcccgggggaaaatatatcaatatga

SEQ ID NO: 158462 - DNA, 582 bp, Homo sapiens
  Payload ID: 11017
  Gene Symbol: NEDD1
  Gene Name: neural precursor cell expressed, developmentally down-regulated 1
  ENST ID: ENST00000554226
  CDS Start-End: 80-582
aacagtccaggcgggagccggaagcccagcgcggagccggccgcggccccctgttgtgttgctgcggagaggtacttggatgcattttacaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtag

SEQ ID NO: 158463 - DNA, 2367 bp, Homo sapiens
  Payload ID: 11017
  Gene Symbol: NEDD1
  Gene Name: neural precursor cell expressed, developmentally down-regulated 1
  Uniprot ID: Q8NHV4
  ENST ID: ENST00000557644
  CDS Start-End: 147-2150
gggaagtgtccggggaggcgcgggccggggtcgcgcacctcccggagccttgtggggtgtgctgcctccgaaaagtttgcctcgtctccacaagtctgtctccttttttgtcaacctcaagtacttttcttttggcaggtacttggatgcattttacaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacactcctctaactgcggtagatttcatgcctgatggagccactttggctattggatcttcccgggggaaaatatatcaatatgatttaagaatgttgaaatcaccagttaagaccatcagtgctcacaagacatctgtgcagtgtatagcatttcagtactccactgttcttactaagtcaagtttaaataaaggctgttcaaataagcccacaacagtgaacaaacgaagtgttaatgtgaatgctgctagtggaggagttcagaattccggaattgtcagagaagcacctgccacgtccattgccacagttctaccacaacctatgacatcagctatggggaaaggaacagttgctgttcaagaaaaagcaggtttgcctcgaagcataaacacagacactttatctaaggaaacagacagtggaaaaaatcaggatttctccagctttgatgatactgggaaaagtagtttaggtgacatgttctcacctatcagagatgatgctgtagttaacaagggaagtgatgagtccataggcaaaggagatggctttgactttctaccgcagttgaactcagtgtttcctccaagaaaaaatccagtaacttcaagtacttcagtattgcattctagtcctcttaatgtttttatgggatctccagggaaagaggaaaatgaaaaccgtgatctaacagctgagtctaagaaaatatatatgggaaaacaggaatctaaagactccttcaaacagttagcaaagttggtcacatctggtgctgaaagtggaaatctaaatacctctccatcatctaaccaaacaagaaattctgagaaatttgaaaagccagagaatgaaattgaagcccagttgatatgtgaacccccaatcaatggatcctcaactccaaatccaaagatagcatcttctgtcactgctggagttgccagttcactctcagaaaaaatagccgacagcattggaaataaccggcaaaatgcaccattgacttccattcaaattcgttttattcagaacatgatacaggaaacgttggatgactttagagaagcatgccatagggacattgtgaatttgcaagtggagatgattaaacagtttcatatgcaactgaatgaaatgcattctttgctggaaagatactcagtgaatgaaggtttagtggctgaaattgaaagactacgagaagaaaacaaaagattacgggcccacttttgaaatttcagtgaataccttaatgttctgtaatttgggaagtttctggcaacacagaactacatagaatcagtattgttttcatggcctccagggaaaaaatgtttttcaagtaagagtaaaaggatgatgggattttataccaacaactgtttcatcttaaaaatatgtatatttttatattaaaaattgtacagtatgtcatctacccaataggaaa

SEQ ID NO: 158464 - DNA, 581 bp, Homo sapiens
  Payload ID: 11017
  Gene Symbol: NEDD1
  Gene Name: neural precursor cell expressed, developmentally down-regulated 1
  ENST ID: ENST00000553609
  CDS Start-End: 102-581
agcgcggagccggccgcggccccctgttgtgttgctgcggagaggtacttggatgcattttacagcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgttcggcacttgaagtactccttgtttaagaaatcactactgggcagtgtttcggataatggaatagtaactctctgggatgtaaatagtcagagtccataccataactttgacagtgtacacaaagctccagcgtcaggcatctgtttttctcctgtcaatgaattgctctttgtaaccataggcttggataaaagaatcatcctctatgacacttcaagtaagaagctagtgaaaactttagtggctgacact

SEQ ID NO: 158465 - DNA, 595 bp, Homo sapiens
  Payload ID: 11017
  Gene Symbol: NEDD1
  Gene Name: neural precursor cell expressed, developmentally down-regulated 1
  ENST ID: ENST00000557478
  CDS Start-End: 102-595
aacagtccaggcgggagccggaagcccagcgcggagccggccgcggccccctgttgtgttgctgcggagaggtgaggttccggaggccctgaggcgcagtcatgcaggaaaacctcagatttgcttcatcaggagatgatattaaaatatgggatgcttcatctatgacattggtggataaattcaacccacacacatcaccacatggaatcagctcaatatgttggagcagcaataataactttttagtaacagcatcttccagtggcgacaaaatagttgtctcaagttgcaaatgtaaacctgttccacttttagagcttgctgaagggcaaaagcagacatgtgtcaatttaaattctacatctatgtatttggtaagcggaggcctaaataacactgttaatatttgggatttaaaatcaaaaagagttcatcgatctcttaaggatcataaagatcaagtaacttgtgtaacatacaattggaatgattgctacattgcttctggatctcttagtggtgaaattattttacacagtgtaaccactaatttatctagtactccttttggccatggtagtaaccagtctgt

SEQ ID NO: 158466 - DNA, 7019 bp, Homo sapiens
  Payload ID: 11018
  Gene Symbol: NEDD4
  Gene Name: neural precursor cell expressed, developmentally down-regulated 4, E3 ubiquitin protein ligase
  Uniprot ID: P46934
  ENST ID: ENST00000338963
  CDS Start-End: 301-4044
gctgcagctgagctcagcttaaaggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 158467 - DNA, 5869 bp, Homo sapiens
  Payload ID: 11018
  Gene Symbol: NEDD4
  Gene Name: neural precursor cell expressed, developmentally down-regulated 4, E3 ubiquitin protein ligase
  Uniprot ID: P46934
  ENST ID: ENST00000435532
  CDS Start-End: 192-2894
ggccttttcccgccgcgctgccgggtgccgctagtgcccgctcgccgcgggaggcgctgctgtcgctgagggagcgcctcctcctcttcctccaactcttccccgcctcctcccgcttctcctcctcctcctccacagttgcctgccctgggcgggggcgagcgcgtccggtttgctggaagcgttcggaaatggcaacttgcgcggtggaggtgttcgggctcctggaggacgaggaaaattcacgaattgtgagagtaagagttatagccggaataggccttgccaagaaggatatattgggagctagtgatccttacgtgagagtgacgttatatgacccaatgaatggagttcttacaagtgtgcaaacaaaaaccattaaaaagagtttgaatccaaagtggaatgaagaaatattattcagagttcatcctcagcagcaccggcttctttttgaagtgtttgacgaaaaccgattgacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 158468 - DNA, 457 bp, Homo sapiens
  Payload ID: 11018
  Gene Symbol: NEDD4
  Gene Name: neural precursor cell expressed, developmentally down-regulated 4, E3 ubiquitin protein ligase
  ENST ID: ENST00000507063
  CDS Start-End: 1-106
gtggaatgaagaaatattattcagagttcatcctcagcagcaccggcttctttttgaagtgtttgacgaaaaccgattgccatggttagtgacaaatcaggagtgaaggtgattcctttatataagttctgcaactgagtgaattccagacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagag

SEQ ID NO: 158469 - DNA, 5707 bp, Homo sapiens
  Payload ID: 11018
  Gene Symbol: NEDD4
  Gene Name: neural precursor cell expressed, developmentally down-regulated 4, E3 ubiquitin protein ligase
  ENST ID: ENST00000508871
  CDS Start-End: 1-2732
caaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 158470 - DNA, 6751 bp, Homo sapiens
  Payload ID: 11018
  Gene Symbol: NEDD4
  Gene Name: neural precursor cell expressed, developmentally down-regulated 4, E3 ubiquitin protein ligase
  Uniprot ID: P46934
  ENST ID: ENST00000506154
  CDS Start-End: 278-4189
ggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatccc

SEQ ID NO: 158471 - DNA, 652 bp, Homo sapiens
  Payload ID: 11018
  Gene Symbol: NEDD4
  Gene Name: neural precursor cell expressed, developmentally down-regulated 4, E3 ubiquitin protein ligase
  ENST ID: ENST00000502612
  CDS Start-End: 1-119
cttgcgcggtggaggtgttcgggctcctggaggacgaggaaaattcacgaattgtgagagtaagagttatagccggaataggccttgccaagaaggatatattgggagctagagtttgaatccaaagtggaatgaagaaatattattcagagttcatcctcagcagcaccggcttctttttgaagtgtttgacgaaaaccgattgacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccacc

SEQ ID NO: 158472 - DNA, 7235 bp, Homo sapiens
  Payload ID: 11018
  Gene Symbol: NEDD4
  Gene Name: neural precursor cell expressed, developmentally down-regulated 4, E3 ubiquitin protein ligase
  Uniprot ID: P46934
  ENST ID: ENST00000508342
  CDS Start-End: 301-4260
gctgcagctgagctcagcttaaaggtcgctggaaatcaagtgctttgtaagtgaaggcattttgactacaagcgattcaagacattttggaaacgtcagtctctggaatgggtcgtctttttctttctatgatatctggtatctaatgttttacttaggataaagactactacttaatagctcttttaggcaccacaaatgattttttcttttgatgcagtgcagctgcttctagcctgtctacggacagagatctttgttatgactttcagcccttaacatgtttggaaatgagaacaaatggcacaaagcttacgattgcactttgcagccagaagaagcaatacttaccctttgtcagaaacctccggagatgacttggatagccatgttcacatgtgcttcaaaagaccaacacggatttcaacgtctaacgttgttcaaatgaagctgactcccagacagactgcactagctccgttaataaaggaaaacgttcagtctcaagaaagatcatctgttccctcatctgaaaatgttaataaaaagagcagctgtctacagatttcactacagccaacaaggtacagtggatatcttcagtctagcaatgtcttagctgatagtgatgatgcttcgtttacttgtatcttgaaggatggtatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 158473 - DNA, 6339 bp, Homo sapiens
  Payload ID: 11018
  Gene Symbol: NEDD4
  Gene Name: neural precursor cell expressed, developmentally down-regulated 4, E3 ubiquitin protein ligase
  ENST ID: ENST00000503468
  CDS Start-End: 1-1204
tatttacagtagtgctgtggtcgataatgaattgaatgctgtgaatgatggtcaccttgtaagcagtccagccatttgtagtggtagccttagtaacttttcaaccagtgataatgggtcttacagcagcaacggtagtgattttgggtcatgtgcaagtatcacaagtggaggttcatatactaacagtgtcatcagtgacagtagtagttatacttttccaccaagtgatgatacttttttgggtggaaacttaccttctgacagcacctccaatagaagtgtgccaaacaggaatactactccttgtgaaattttttcaagaagtacaagtacagatccttttgtccaggatgacttggaacatggattagagattatgaaattgccagtgagcaggaacacaaaaattccactaaaacgttactcctccttagtcatttttcctaggagtccttcaactacccgaccgacttctccaacaagtctgtgtactcttctgagcaaaggatcctatcaaacttcacaccagtttattatttctcctagtgaaattgcacataatgaggatggcactagtgctaaaggatttctttcaacagctgtcaatggacttcggttatctaaaacaatttgtacccccggagaagtaagagacatacggccgcttcacaggaagggctcgttacagaagaaaattgttctttcgaataatactcccagacagactgtctgtgaaaagtcatctgaaggatattcttgtgtttcagtgcatttcacccaacgaaaagcagctacattagactgtgaaacaacaaatggtgattgtaaaccagaaatgtcagaaattaagcttaattctgattcagagtatattaagctcatgcataggacatctgcatgtttgccatcctcccaaaatgtagattgtcaaataaatatcaatggagaattggaaagaccacattcacagatgaacaaaaaccatggtattttacgaagaagtatttcattgggaggagcttatccaaatatttcctgtctatccagccttaagcacaattgttctaaagggggaccatctcagttactcataaagtttgcatctggaaatgaaggtaaagtggataatttatcaagagacagcaacagagattgcacaaatgaactgtctaattcttgcaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccgagagtcttccgagaactgggaaattataagagaagatgaagccaccatgtatagcaaccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttacttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcatgctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgttggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatctatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaa

SEQ ID NO: 158474 - DNA, 2920 bp, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENST ID: ENST00000256830
  CDS Start-End: 1-2616
atggcgaccgggctcggggagccggtctatggactttccgaagacgagggagagtcccgtattctcagagtaaaagttgtttctggaattgatctcgccaaaaaggacatctttggagccagtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgatgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctt
